United States Patent 10,407,724 (METHODS AND COMPOSITIONS FOR SCREENING AND TREATING DEVELOPMENTAL DISORDERS) - sequence listing, part 53

SEQ ID NO: 1263 - DNA, 137919 bp, Homo sapiens
gaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtaggtggcagccgcccccgcggccccgggccccgcgccccgcgccgcgctgaccgccgtattctgcttcccccgcaggtggcggtggcatgagggtcggaccccagtaccaggcggtggtgcccgacttcgaccccggtgagtagcggccccggccggccggcggcggggatgagcgggagccccgggtccccggcgagcccgagggggcgggagcccgccgacaactttctttttgtgcgttcgccctgccgtccgtggggagaacagcagggcgaggacgaggaggcgcacacgcacacgagtgttctgcaaacgtgcctctgcacccgggggaggccaggtcgcccccagcagggccggcgccgctgcccccttgcgcctccgaggactgcgggtggcgtcggaggtggccacacctggcctgggggcgctgggggtccctgcgtccaggtgagctgcgcctcggccaggggtaagggtggcagtgccggagagttagtgtcctgcgagcgccccggacttaggaggtccccagagacccctttctcggaacccttcccaaaggctgctccccacgcctttgctcctcctctcagcctctgggctcttgctggctcctgactgccctcccatccagaaggcgagtagaagaacgaccccccaaaaccagtcaataaaagaagtgtgttttccagagggcgcctgcctggggaagagagtctcgcgtgtggcagttggattttaggacctatttgtaaatgtgtgtatttccttttttttggaggaagagattgtgaaattgagaagcatcagaagctttagcctaacaaatgcttttcacctacaagaaagccctacaccctagaatggaacacttagttccctggctgctattctgtgtagaagcaaatttaaagtggtacaagaaaaaaaatccgatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagataaacgcatacatgttttttccttggaaacaagactgcagaaaattgcaatgatctagtccttgaaaaaggcgattgctctcaagctgttattaaggtactaaactgcactttgaagtgaaaatacatagaggtcctaggtgagctcttggacactctggaaataaatgacttcctaaattggccttctaaattttgatttgttgacgtaaatctgttaaatttatttgtctaatactcgcgtttgtgtttcttttaagtccatgttagtgtttttgatagtttcctcttctccccaattcttttttttttttttggtagtcacttctcgtttatgagtgacaggatagaactaggtggccaggctatatctcttgtatgcttggctcctccgttccttggttggccaccaggggaagcatactgttttttggttacagttgaccctgtcttcattttgtaggtcaagtctatctttgctttaaaacacagaacataaagcttgttaccaaattttcctaatgtattatttttaaaaatcgacttccacaaatctttgagtaagttggtaggctttttgatacatttttgttaacataaattttgaaaactttatgtagatgtgttggatgtgactaaggaaaagggcatatttgtcaacaacaggaattagatttctgacattcatcgaaatattgacatcagctctgcattgttagtaatgagtttgacttctttggagttatacttttctttgaaacagcaaatataatattttgaactgtctttgggctttttgttggaatagatatgagcataaacttgctagtgaccagctattctaaaatggaaaacatttatcagattgcagtagctcacacctgtagtcccaacacttggggaggccaaggctggaggatctctggagctcaggagttggagaccagcctgggcaatgtagtcagactctgtctcaacaaaaaataaaaaaattagctgggcatggtggcatgtgcctgtagtttcagctacgggggggtctgaggctggaggatctctgggaagtcaaggctgcagtgagcagtgatctggccattgcactccagcctgggtgacagagtgagaccctgtctcagaaataaaaaggaaaacatctaactgttttgctgcatagtcttgctgccaattggttgagtattgatattaaaatttccaaatttcttttttttttttttgagacggagtcttgctctgtccctcaggctggagtgcgcagtggtgtgatctcagctcactgcaagctccgcctcccaggttcacgccattctcctgcctcagcctccagagtagcagggactacaggcgcccaccaacactcctggctaattttttgtatttttagtggagacggggtttcaccgtgtcagccaggatggtcttgatctcctgacctcgtgatccgcccgtctcggcctctcatagtgctgggattacaggcatgtgccaccgcgcccggccccaaatttctttattttgtgtttgttttaatctggaaaggaatctaactggtgtaaagtaatttcaaaccttgttttgccaacctaagcagggggacacagttttctagatatggcagaaaattgagactttactatttcctagtggttttttatgtgtcttttcatttaacttaaaagcttaaggggaaggaaggcttccattttggaatagaaatgatacaacattttttttttttttaatacggagtttcactcttgttgcccacgctggagtgcaatggcgtgatctgggctcaccgcaacctctgcctcctgggttcaagcaattttcctgcctcatcctcctaagtagctgggattacaggcatgcgccaccatgcctggctaattttttgtatttatagtagagacagggtttctccatgttgatcaggctggtctggaactcctgaacgcaggtgatccacccacctcagccttccaaattactgggattacaggggtgagccaccgtgcccagccaactgatgtttgttttatagcaaaattctttcttagctgtttaagacttaagacaggttctttccatgactgcaatttaagagtagtgaattgagtaataaattaagaattgagagtttgatccttactagtttttatttcctcctcctacttgtttttttcttttttcttttattttttgagaccaagtctcactctgttgcccaggctggagtgcagtggcacgatcttggctcactgcaacctccacctccgaggttcaagtgattctcctgcctcagcctccagagtagctgggattacaggtgcccaccaccacgcccaactaatttttgtgtttttattagagatgcggtttcaccatgttggccaggctggtctcgaactctttgcttcaggtgatctccccgccttgtccttccaaagtgctgggattacaggcgtgaaccactgtgactgcccctccccccgcctttttttttttttttgagacggagtcttgatctgttgcccaggctggagtgcaatggcacaatcttgactcactgcaacctccatctcccaggttcaagtgattctcctgcctcagcctcccaagtagttggaactacaggtgcgtgccaccatgcctggctaatttttgtgtttttagtagagacggggtttcaccatattggccaggctggtcttgaactcctgacctcaggtgatctgcccccctcggcctcccaaagtgctgggattacaggcgtgagccaccatgccctgtccctacctcagttttgagtgtgtctttgttcttctcttttactagaatttgaacagagaggtggacgtgaaacttaacaggcagctttttttcttttctttttttattatagtaaaataagtaactatggtagagatgcatgaatggaggaatttgactttgattttttttttttgagacagagtctcgctctttcacccaggctggagtgcagtggcatgatctcagctcactgcaacctccatctcctgggttcaagcgatcctcctgctgcagcctcctgagtagctgggattacagacgcacaccaccacacccggctagtttttgtagttttagtagagatgaggtttcaccttgttggccaggctggtctcgaactcctgacctcaggtgatccacccaccttggcttcccaaagtgctgggatttcaggcgtgagccactgcgcccgaccttttttttttttttttttttttttttgaaatggagtctttctatgttgcccaggctggagtgcagtggcacaatcagctcacacagcctctgcctcccgggttcaagcagttctcctgcctcagcctcctcagtagccgggattacaggcgtgtgccactatgtctggctaattttggtatttttgcaattttttttttttttgagatggagtttttttctcttgttgctcaggctggggtgcaatggcatgatctcgatctcggctcacctcaacctccacctctcaggttcaagcaattctcctgcctcagcctcccgagtagccgggattacaggcatgggccaccacacccagctaattttgtatttttagtagggatagggtttctccatgttggtcaggctggtcgtgaactcccaacctcaggtgatttgcctgccttggcctcccagagtgctgggattataggcgtgagccactgcgcagccctaattttggtatttttggtagagatgggtttcaccatgttggccaggctggtctcgaactcctgacctcaggtgatccactcacctcggcctcccaaagtgttgggattacaggtgtgagccactgtgcccggcctgatttttttgtcagattttacttatttgcggtatgccagcttgaccctatttaggtttgaaagcaaatggttggagctaagactatctgatatttcctatgcagttcaaaggaagatttaattctgtcatgccttacaaagagtgaatgaggtggatagagcacgttagtcttaaaatcctgattcagttcttttttttttttttttttgagacggtgtctcgctctgttgtccaggctggagtgcagtggtgtaatccgggctcactgcaagctccgcatcctgggttcatgccgttctcctgcctcagcctcccgagtagctgggactacaggcgcctgccaccacgcccggctaatttttttgtattttaagtagagacggggttccaccatgttagccaggatggtctcaatctcctgacctcgtgatccgcccgcctcggcctcccagagtgctgggattacaggcgtgagccgccacgcctggccctgattcagttcttataaaataattaatacctagattagatcggtgtagtgtggcattgcttggtagttagaataccatttgtgtttacactgaaataaaaagttttaccaacttttaaagagttaaaaaaaaaaagagttaaaaacctaagtgcagccctacacttttaacttaggctttgttcttacatgtgttgtccagactgcctttccatgctgtctgccgcagattatgctgagttgtcattggtttcttttaatattcagtagttacagaataatagggtaagaggggggatgcttatctatcctacctctggttggttctttcctacataagcaaagcatcacttattttgaaatgaataatgtttttctttccttttttttccttttttttttgagatagggtcacactctgtcaccagtatagtggtgtgatcatggcggcagtgaacttgaacctcctgggcgcacactatcctcccatccatactttacctcgaaagtagctgggactacagatgtccacgaccatgcctgactagtttttttgtattttttgtagagacaagagttttgccacgtagtccaggctggtctcgaactccttggctcaagccatctgcctgccttggcctcccaaagtgctgggcttacaggtgtgagccaccgtgttcagccattattattactattttttaattttttttattctctttatacacgtccttggtgcttcagaggcgtacattgttaatgatgaatatttttgagatagtggccctttaaaaaagcaacctttattttgaatgtttaatccaatgtatttaatcagatctgaaaatttgtggttgtcattggcttaactgtcacttcagagttgacttctgtcagaaaactgtgttatgttttcatgtggaataggtaattttactgaacagggtgtcttgatatgcctttcatttgttttcactggtgattctatgttctgctttttttatgctttagatcattgtaaaaaaaatatggtgaatgctttgtggttttgttttgttttgttttttttttttgaaacaaggtcttgctctgtcacacaggctagagtgcagtggccctgatgttggctcacttcaacctctgcctcccagactcaagtgatcctcccccctcagcctcatcagttgctgggaatacatgtgcacatcaccacgcttgagcccaggctggtctctaactcttgtgctcaagcagtcttcctgccttggcctcccaaagtgctgggatcacaggcatgtgcctggcaatgctttgtgatttatttatttaattattattattatttttttgagacggagtctcgctctgtcacccaggctggggtgctggagtgcagtggcgcgatctcagctcactacaagctccgcctcccgggttcacgcccttctcctgcctcagcctctctgagtagctgggattacaggcgcccaccaccacgcccggctaattttttatatttttagtagagatggggtttcaccgtggtcttgatctcctgacctcgtgatccgcccacctcggcctcccaaagtgctgggattacaagcgtgagccaccgcgcccagccagtgattgattgattgattttagttttattttttattgtattttgagacagagttttgctcttgtcacccaggctggagagcaatggtgtgaccttggctcactgcaacctctgtctcccaggttcaagtgcttctcctgcctcagcctcccgagtagctaggactacaggtgtgtgccaccatgcccagctaatttttttttttttttttttgaagacggagtctcactctgttccccaggctggagtgcagtggcgtgatctcagctcactgcaagttccgcctcctgggttcacgccattctcctgcctcagcctcccgagtagctgggactacaggtgcccgccaacacgcctggctaattttttgtatttttagtagagatggggtttcaccatgttagccaggatggtctcgatctcctgacctcgtgatctgcccgtcttggcctcccaaagtgctgggattacaggcgtgagccaccgcgcccggctgctaatttttgtattcttagtagagatggtatttcgctggctgggcatggtggctcacacctgtaatcccagcactttgggaggccgaggcaggcggatcacttgaggtcgggagttcaagaccaacctggccaacatgatgaaacccctctctactaaaaacacaaaaattagctgggcgtggtggtgcatgcctgtaatcccagctactcagaaggctgaggcaggagaattgcttgaacccaggctgcaaaggttgcagtgagcgtagatggcaccactgcactccagcctaggtgacaaagtgagactctgtctcaaaaaaaaaagacggggtttcactatggtggccaggctggtttcgaactcttgacctcaggtgattgacccgccttggcctcccaaagtgctgggattacaggcttgagccaccgcacccgaccaaacactgatttaatactaggcaatatttgcttcaggtacagctaaagcctcattcccgccttctttcttcattaattcacagttggtttatattatttctgtgatagtttgcatcttctgagaagcagatgacaagacagaattagatgtgcaagaggttcattagggtatgcttgtgaaggataaagagaggaaggaggtgtaggtggcaagagcctttacactggaagcatgtgtgacacctgtgaaagaagagagggaaggaatgatgattaatgattgatagaggaacctcaaactgcagtgcagcttgcagttcagagaaaatctcagccagagtagattgttagaagagtctgttgggcaggaatggtccttctttgtgaacatctgctgtgttcagtcattggctgggagcagcctagagtagcctagccttggtatgggtgctgtagtagatttctggtagctggggctgtcagttaactacactccttgcaacattttctctcttgaagggaaatctgagtggcacactcaaggctgtcagaattcccatacgtgtttttgtacttaaatacatgtgtgtaattccagcactttgggagggtgaggcgggaggatcacctgagatcaggagttcgagaccagcctggccaacatggcgaaaccccgtctctactaaaaatataaaaattagctgggtgtggtcgcgggtacctgtaatcccagctacttgggaggctgaggcgggagaattgcttgagcccgggaggcggagattgcagtgagccgaggttgtgccactgcactccagactggacgacagagctagactccgtctcaaaaaaaaaaaaaaagtgataatatgttttcttgttattgttagtgtttttgtaaatggaataatctatgctattcatgtacttttatgctttccaaacaagtacatttccactagcaaggtaaacaactttgttttcaccttgtcttcgtcatggtgttagttaggttattaattttttttaaatgctatcctttaatggcttatattagcatttttttcttttcttttcttttctttttttttttttttttttggagatggagtttcgctcttgttttgttccccaggctagaaatgcagtgacgcagtctcctctcactgtaacctccgcctccccggttcaagtgattgtcctgcctcagcctcccgtgtagctaggattacaggcatgtgctaccacgcctggctaattttaaaaaatatttttagtagagaaggggtttcaccatgctggccaggccggttttgaactcctgacctcaagtgatctcccgcatcggcctcccaaagtcctaggattacagacgtgatccactgtgcctggcctcttctttctttttttgtagacttgatatcgttctgcctcttaggctggagtgcagtggcatgatcacagcacactacagcctcagcctccagggctcaagtgatcctcctgtctcagtttcctgagaagctgggactacaggcatgagccagtatgcctgactgatttttgaactttttgtagagacggggttttgccaagttgcccagactggtctccaactcctgggctcaaccagtccttctgctgtgtcctcccaaagtgttgagattacaggcatgagtcactgtgcctgtaattaagttttccaattaatgatgaggttaagtgtcttatgtttttaatttttaatttttaatttttttaagaccttttttttccccttttttgagatgagttcttactcttgtcgcccaggctggagtgcagtggcgtgatcatagcgtactgtagccttgaacttctagggctcaagtgatcttcatacctcagtttctggagtagtttggactacagttgttcaccaccacacccagcaaagaatgtgacaaaaagtactaagtgtgttttagctaagtatcgataagaaaagagtgtctttttatttattttttatttgtttatatgtactttttgagacagggtctggctctgtcatccaggctggagtgcagttgtgtaattttggctccctgcatcctcagcctctcaggctcaagtaatcttcccaccttggcctccggagtagctgggtttataggctcttgccactatgcccagctaatatttgtattttttgtagagatggggtttcaggttttgttggtcttaaccctggcccaggggtgtctgtaaatttttttttcttttttttgccactcagtttcctcctgtgaatgtatctttcttttgctatttttcttttttttcccccttagggtcttgctctgttgcccaggctggagtgcggtggcttaatctcagctcactgcaaccttcatctcctgggctcacatgatcctcccacctcagcttccgaggtagctgggactacaggagtgtgccaccacgcctggctaatttttgtgtttttttgtagagacagggtttcaccatgtttcctaggctgttttgctgtttttctatagggtgttggtttttataggttttggttttttgtatggatttgtgtgagttctttttatttatatatttggatattctttgttagaattgcacatatgttttttgttttttctttaatattatgtgtgttgcggggaggaggattgagtttatttgactaggaagggataaaaatacattcctgactggagactgtactcagagattggtcttggtgtatacccctgatttctaagatgaatgttactgagaattgacaattttttttgttgattgttgtgtttccactaagttattcatctcattttggcctgctattagctagttgacccaaatcacagtgctggatgacttgaaaagctctgatttaatttttgcctagtatatagttatagtagcatataggttaaaggttaaagttacagctttgatcctataatggtcagttagtttcccacgaaaggttaaaatgctatagactaaaactaacagctgtcttagggatttgccactccttataaggcaatgggtagtgtgtggatagggaggtacaacttgtcatcactaacaaaaccctcgaaagaatgatctatccaggttgcttactctgtgccaggctagttttaacacacatcaaatcatttgaccctcacaacagtcatatgatgtaaagttactatctccattttccagatgaggaaacagaggcattgagaggcttagtcttatggttgaacctaataacttgccgtggtaatccagtccgagaggccctcagctgtaagaggcacctttattttatgtttcagtaagaaaggaaaaggatcaacaagatagactgttaattttaagtattataagaattctgatttataagtataatcagaattcaatttagtgtattttagagagggtcagccagaatcctctttaagagaaaacacttaggctgggtgcagttgctcactcctgtaatcccagcactttgggaggctgaggcaggtggatctcccaaggtcaggaattcaagatcagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggtgacagagcaatattccatctcaaaaaaaaaaaaaaaaaaaaaaggaaaagaaaaaacacttaggagcaagactttattggatccattgattagttgtttccatgtggccccaggtgttggggaattttatgtttcgggttgccagagccaacttgtagtccagttacattcctcttcttcctggcagtgagaacaccggtgaaatgggaggtggttagcttggttgcctggggacaaattggactgagttgctttattcctgcatgtatgttgaaatagtcatcttcacaacttagaatatagttggagttttttttagaagagccatttattttgatggtgtgactgaaggctatacatacagtcatgtattgcaaaacaaatgtcattttggtcaaggacagtggtcccataagattataatggaactaaaaaatttctgtcgcctagtaacttcaccttgtctatagtgcaacagcgtgtagcattacttaggtgtttgtgtggtgttggtgtaaacaaacctactgcactgccagtcttacaaaatctagcacatggagttatgtatagtacatagtacttggtaatgacaataactgtattactggtttgtggatttactatgctatactttgtatggttattttagagtgtattcctacttataaaaattatcagtttgctgtaaaacagcctcaggcaggtccttcaggaggtattccagaaggaaggcattgttactctagaatatgacacctccatgggtcttattgcctctgaagaccttccagtgggacaaggaaggtatggagttggaagatggtgatattgatgatcctgactgtaggctaggccaatgtgtgtgtctttgtggttttttttgtttttgtttttgaaatggagtctcgctctgttgcacaggctggagtccagtggcatgatctcggctcactgcaacctctgcttccctgcttccagtgattctcctgcctcagcctcgtgaatagctgggattacaggtgcgcgccaccatgcctggctaatttttgtatttttagtagaaatagggtttcatcatattgggcaggctggccttgaactcccgacctcaagtgatctgcctgcttcggcctccgaaagtgctgggattacaggcatgagccaccgtgcccggcctaatttttgtatttttagtagagacggggttttgccatgttggccaggctggtcttgaactcctgacctcaggtgatttgcctgtcttggcctcccacagtgctgggattacaggtgtgagccactgcacctgactgtatttacacccatactctccctgaaggttgtagttcctgccctgctttacttttactggcatagaagctgctgggcttggtgttctgctttcaaacttagcgtggatatagggagttcagcggggaggaagagaagagtaggtgcttaactagttttgatcttactcagtaccagagagtgttctgggagctagtggtgtcatgtatgtctgatttctttgagggtggtagcgtagttttttgaaccaccaaatcaggttttaagttttttttttttttttggaggggagatagggtctcaccctgtcccccaggctggagtgcagtggcgggaacatggcccactgcatgcagccttgacttcttgggcaccagtgatcctcctgcctcagcctcccaggtagctgggattacaggtgtgaggcactgcacctggctgttaagtattatctagtataaactcgtcagagctaaataggggctgaattttctaagaatatgtgcttggtttgggtcttttcttgaataggcttttgtttttgtttttttgatttttttgggttttgtgttagtttttttttttttttttgagacgaagtctcactctgtcgcccaggctggagtgcagtggtgtgatcttagctcactgcagcctctgcctcccggattcaagtggttctcctgcctcagcctcccaagtagctgggattataggcatgctccaccacgtctggctgattttgtatttttagtagagacggggtttttccatgttggtcaggctggtctcgaacttctaaccttaggtgatccgtctgccttggcctcccaaagtgctgggattataggcgtgagccaccgcgcccggctgagtaggcattttttaatggacatttgataaggaccaagtgcaactgtatatcaaatggaaatctagggaaaaattgtcttttaaattgcagttaaaagctgattatccctattgtctcttgctttccttataatgaatttgtataaattggagatgcacatcttgcatagatgtgttttcttttttttatataaagtggtgcaagtcacatcacaaaattgactattttttggccaggtgtggtgactcatgcgtgtaatcccagtgctttgggaagctgaggcaagtgggtcacctgaggtcaggagtttgagaccagccaggccaatatggtgaaaacctgtctctactaaaaatagaaaaaagctagccaggcgtggttgctcatgcctgtaatcccagcactttgagaggctgaggtgggcagatcacgaggtcaggagtttgagaccagcctggccaacatggtaaaaccccatatctactaaaagtataaaaattagccgggtgtggtggcacctgcctttaatcccagctactcaggaggctgaggcaggagaatcgcttgaacccgggaggtggaggctgcagtgagctgagatcgtgccactgcacactagcctgggcaacagagcgagactctgtctcaagaaaaaccacaaagtacaaaaaattagccaggtgtggcggtgcacgcctctaatcccagctacttgggaggctgaggcaggagaattggttgaaccggggaggcagaggttgccatcagccgagatcacgctactgcactcaagcccgggcgaaacagagagactccatctcaaaaaaaaaaacaacaaaattaaccgttttacaatgaacaattcagtggcattcagtgcactcgcattgttgtggagccactgcccttgtctagttccgaaacattttcatcaccctaaaaagaaaatctcacatgtgttagaatgaagaatgagttacttcttattctccattctcagtaccaggcaaccactaacctgctttttgtttctggattacttattctggaactttcacgtaaatgggtatgtgaccttcatgtctggcttctatcacttagtgtaatgttttcaaggttcattcatgttgaagcttgagtcagtattggtactttctgtgcttcattgcttttgttttgtgttgttgttttttttgttttgccttgtttttgttttttgagatggagtcttgctctgtcgtccaggctgaagggcagtggcgtgatctcaactcattgcaacctctgcctccctcgttcaagcgattctcctgcctcagcctcccaagtagctgggattataggtgcgcaccaccatgcctggctgatttttgtatttttagtagaaatggggtttcaccattttggccaggctggtcttgagctcccgacctcaggtgatacacctgtctcggcctcccaaagtgctggggttacaggtgcctggcctaattttaaaattttttttttgtggagagacggggtttgtttatgttggccaggctggtctctaactcctgacctcaagcactcctcctgcctcagcctcccaaaatgctgagcttataggcatgagccactacacctggctcattcatttgttgatggacatttagcttgttgttaccttttgattattgtgaaccgtgctgttatgtacattcatgtacaggtatttatctgttttcatccttttaggggtatatatctattagtggaattgctgggttatggagtaattctgtgcttcacttttttttttttttttttttttttaaatttttattttgagacaggctcttgctctgttgcccaggctggggtgacagtggtatgatctcagctcactgcaacctctgcctcccgggttcaagcaattctcctgcctcagcctcctgagtagctggggttacatgtgcatgccactacacctggctaatttttgtatttttagtagagatggagaaacatgttggccaggctcgtcttgaactcccgacctcaggtgatccgcctgcctcggcctctcaaagtgctgggattacagatgtgagccactgtgcctggtctgtgcttaactttttgaggaaccattaaattgtttttcacagtagcttaaccattttatactccatgattaacgtatgagggtttcaatattctactttttattttctgttttttgagatggagtctcactctgttgtccaggctggagtgcattggtgcgatctcggctcactgcagtttccgccttccaggttcaagtgattctcctgcctcagcttcctgagaagatgggattgtaagcatgtaccaccaagtgtggctaattttttttttgtattttttagtagagacagggtttcaccgtgttggccaggctgatcaggctggtcctgacctcaggtgatctgcctgtctcggcctcccaaagtgctgggattacaggcgtgaaaatgctactgatgacagtgcagagagtcctgagatgcttagagtagtggagttactcgatccttccctgtggtggagggttgggagttgaagaaaccaggaagtcctatatgaaatggtcctttaaggccgggtgcagtggctcacccctgtaatcccagcactttgggaggccgaggcaggcagatcacgaggtcaagagattgagcccaccctggacaacatgacaacatggtgaaaccctgtctctactaaacatacaaaaattagctgggagtagttccagctactcgggaggctgaggcaggagaatcgcttgaaccctggaggtggaggttgcagtgagccgagattgcgccattgcgctccagcctgggcaacaagagcgaaactccatctcaaaaaaaaaaaaaagagaaatcgtcctttaagtcaagccttaaaacgtaggaattacctagttaatttgaatattaatattatatgatatataagctgtacatgttataaaaattattttgaaaagtttaatctttaaaattttagtttagattttccttgtagttatctagagctgtgctgtccaatagtgtagccactagctacatataactattgaaatttaaattaattaaaattaaataaaattaaaaattcagtccttctgttacactaggcacattttagatattcagccatcatatatagctagtaggtgccatattggacagctcagaatagagtatttttatcctcccagcaagttcagttgggtggcaatgatctagacattttgatgaaatgaaagcttcattattattgctattattattattatttttgtgtgtgtgtgacagagtgtcgctctgttccccaggctggagtgcagtggcgccatctcagcttactgcaagctcgcccacccgcgttcacaccattctcctgccttagcctcctgagtagctgggactgtaggcgcccaccaccacgcccggctaattttttagtagagacgaggtttcaccgtattagccaggatggtctcaatctcctgacctcatgatccacccgcctcagcctcccaaagtgcagggattacaggcgtgagccaccgtgcccagcccaaaagcttcgttattattaatttttataattcagacgttttgcctcttttgtcaagtgcatgaaatttgagatgggtacagctgagaaatgtatgatggctgtgtgctgaattcctctaggggtgtatttgtttaaatattgccaataaggtgttcaaaataaggttatttgaaagagcaagttgaaatggaaagcttaggagagcttagttttttgtttgtttgtttttttgagatggagtttcgctcttgttgcccagactggagtggaatggtgtgatcttggctcactgcagcctccgcccccacaccattcaggcgattctcctgtctcagcctcctgagtagctgtgattacaggtgctcaccaccacgcctggctaattttttgtattgttagtagagatagggtttcaccatgttggccaggctggtctctcctgacctctggtgatcctcccactttggcctcccaaagtgtagggattacaggcatgagccaccatgcccggcctcagcctatagttcttttaatgcccttgtctactaattctatcatctgtgtcatttctgggtcagtttcagttgcttgattcttttttttcttcctctttttgggttgtcttttccacctactttgcttatctgttgatttttggatgccagacatcatgaattttactttgttggaggctggatatttttgtatttctataaatattcttgagttttgttctgagatgtggttaaaatacttaaaaatagtttgatgaagtcttgcttttaagctctgttaggtgagatcaaaaccattttagtgtagggctaagtatttcccactattgagtcaaaatccttttggggattctgtgtgatagcccatggactatgtggttttccactctggctgtgaggaactggcactcttcctgttcccatgtgagccttgtggattgttccatttgattcttttgggtattttatttatatttttagagaaggtgtcttgctctgtcactcaggctggagtgcagttttgtgatcatagctccttgcagcctcaaactcctgggctcaagccatgcaccccatatagctggggctataccatgcctggttatttttattgttttagagatagggtctcactgtgttgcccaggctggccttgaagactccagggttcaagcgatcatccctcctcagcctccccagtagctgggattacaggattttgccatcacatctggctaagggggtgtggaaccagggacaaagaccaaatacatatttcataatatactacacaaggtaaatctggttcatgtcactctaccttgactggaagcataagtatagattttgccatgttgcccaggctggtcttgagctcctagcctcaagcggtcccctcttcccaaaccttggcctcccaaaggtgctaggattgcaggcatgagccactgcacttcctgagtagctgggattacaggtgcgcgccaccacgcccgctaatttgttttggatttttagtagagacggggttttgggccaggctggtcttgaactcctgctcttaagcgatctgcccgcctcagcctcccaaagtgctgggattacaggtgtgagccaccacgcccggtctgatttttgtattttttgtagggatgggggtttccccatgttacccaggctgctcttgaactcctggcttcaagcaatccacctgcttcggcctcccaaagtggtgggatttcaggagtaagccactgcacccagccttgttcatttcaatattcctgatgaagtactccatctgatctcatttgctcttagaaatctgcttgctggttaccctgtgcagtggctcacacttgtaatcccagcactttgggagactgaggtaggaggattgcttgatgccaggagctagagatcagcttgggcaacatagcaagaccttgtctctacgtgcacctgtagtcctggctacttgggaggttgagatgggaggattgcttgaacccatgggtttgaggctgctatgaggtatgatcacaccactgcattttagcctgagagacaggagacagtatctcttagcaaaaaaaaaaaaaaagaaaaaacaaatctgactaccgtattgatgattctagtccagaattttccaaaggagtataggtggtttttttggttgttgttgttgtttgttttgttttttgagatggtgcgagtctcgctttttttgttttgttttgtttttttgagatggagtcttgctctgtcgcccacgctggaatgcagtggcacaatctcggctcattgcaaccttcgcctcccgggttcaagcagttcttgtgcctcagcctcccgagtagctgggactacaggcgtgcgccaccacgcctggctaagttttgtatttttggtagagttggggtttcaccgtgttggcctggctggtatcaaactcatgacctcaggtggtccgccattctcagcctcccaaagttttggaattacaggtgtgagccatcgcacctggcctttttttttcttttttaaacatatttatttatcatttttttttttttttgagacggagtctcgttctgtcgcccaggcgggagtgctgtggcgcgatctctgctcactgcaagctccgccttccgggttcacgccattctcctgcctcagcctcccgagtagctgggactacaggcgcccgccactgcgcccggctaattttttgtatttttagtagagacggggtttcaccatggtctcgatctcctgacctcgtgatccgcccgcctcggcctcccaaagtgctgggattacaggcatgagccaccgcgccccgccatccttttttttttttttaaagaggtggagtataactatgttgcccaggctgatcttgaactcctggcctcaagcagtcctctaccttggcctcacaaagtgctgggattacaggagtgaaccaccgcgcctggctgagataggttgttttttgaattaactattcttttttttttttttttttttttttgagacagagtttcgctgttgttgcccaggctggagtgcagtggtgcaatgatctaggctcactgcaacctctgcctcccaggtttaagggattcgcctgcctcagcttcccaagcagctgggattacaggcatgtgccactacacccggctgattttgtatttttggtagagacggggtttctccatgttggtcaggctggtcttgagttcccaacctcaggtgatctaccctccttggcctcccaacgtgctgggattataggcgtgagccactgcacccagccatgtttttaagatttttaaacatctggctcttttttttttttttttttgagacggagtctcgctttgtcacctaggctggagtccagtggcgccatctcggctcactgcaagctccgcttcctggattcactccattctcctgcctcagccccccgagtagctgggactacaggcacccgccaccatgcccggctaattttttgcatttttagtagagacggggtttcaccacgttagccagcatggtctcgatctcttgacctcgtgatccgcccgcctcggcctcccaaagtgctgggattacaagcatgagccactgcacccagcccttctggctctttttaaatgtcagatattgataactcccagactgaattaagattttatatgtcagatgattaactatcattttgagttgttgcttagttctctgcttgcttggcaacaggtcagtttccatggtattgccatttttgtaccgcattcttagtggagctgagaggttgggggtgaggctacagggccgaactctataaactagaatagctaaacttttatccagtttggtgtataaaattttttgatatacagctcaggaaaagcatataaaaaacaaaaataaaaataatttctgaataatttttttttttttttgagacggagtctcgctctgtcgcccaggctggagtgcagtggcgtgatctcggctcactgcaagctccacctcccgggttcataccattctcctgcctcagcctcccgagtagctgggagtacaggcacgtgccaccatgcccagctaattttttgtatttttagtagagacggggtttcaccatgttggccaggatggtctcgatctcttgacctcgtgatgtgcccgccttggcctcccaaagtgctgggattacaggcgtgagccatagtgcccggcccccccgcccccacctttttttgagacagagtcttattctcacccagcctggagtgcagtgttaacgatcttggctcactgcaacctcttcctcctgggctcaagtgattcttctgcttcagcctcccaagtagctggaactacaggtgtatgtcgtcatgcctggctaaatttttttttttaatattttttagtagagacggggtttcaccatgttgtcccagctggtctcgaacccctgggctcaagcaatccacccatcgtggcctcctgcagtgctggggttataggcatgagccaccttggcctgcataattcttttttttttttttttttgagatggagtttcgctcttgtcgctcaggctggagtgcaatggtgcgatctcggctcaccgcaacctccacctcctggattcaagcaattctcctgcctcagcctcccaagtagctgggattacaggtgtgcaccaccatgcctagctaattttgtatttttagtagagacagggtttctccatgttggtcaggctggtctccaactcccgacctcagattatctgcccaaccttggcctcccaaagtgctggtattacaggtgtgagccaccacgcctggccattaattcttttttaagaaagagtttcattgctattaaacaagtttgaaaatcacagtttctgcttgagtagaaaatacaaacttgggtttctaccactacactttcacaacatgcttttgactccagatttgaggggggatttctccccaacaggaggtaggccatcagttctgcagtgggcagcagctgggcatcctctaattgaattcagttctgacactgtctacactacccgcttagagatggatggtgacacatcacacaggttgaggactcagtcctatctttgatagtgaacgtaaaccttcatttattttgtctgtggttctgaccagccagctgcaaatttcaagagttcctgcagatacctccttgacttcaattactttgctagagtaacttacagaactcagggaaatgtgtttatccatttattacaaaagatacatgtgtatatgtgtgtgtgtgtgtgtgtgtgtgtgtgtgtgtgtgtgtgtgtatgtgtgtgtgtgtatatatatatttaaattttatttgagttagggtctttccccagttgccaaggctggagtgcagtggtgcgatcacagctcactgcagcttcaacttcttggactcaggctatcctcccatctcagcctcctgagtaggtgaaactatatacacacagcaccatgcccagctaattaaatttttttttggtagagatggggtcttgctgtattgcccaggctggtcttgaactcctgggctcaagcagtcctccggccttggattcccaaagtgctgcaattacaggtgtgagtcatcatgtttggcctacaaaggatatttggaaggatgcaaataaacagtcaggtgaagagatacatatagggccaggattgaaatggtccctagcactggcacttctgtcttcttggagttgggatgggccaccctcccctcacatggctgtgcttctctttactcctgcaatcccccatgtgtttggctccctacaagccatgttcagctccctgcaagctctctgaacccaatcctttcaggtttttatgaaggcctcattacgtagggatgactgattaaatcttttggccattggtgatgaattaaaagttcagtccctctcccctccttggaggttgaggtgggagttgaaaccatttgtcatcctaagctaacaaacggttgccagctattggtcaactcattggcatacaaaaagacacattactttgaagataccgaggattttaggagttgaagggccaggaaacaggaaggccaaatatatatttcacaatatcacaatatgttattaagagcaaatagtgatagaaaagtgaaagtgatgatagcagaaatgtaaagtgtaggttctataaacagtgcagatgagaacaaagctaacagttatcaggcagtctaaatgcatgcagttttttaccttagacacattcgttcgttgactgtttaattgtaaagaaaaatcaatttaagaacatgtatgaaattgcatttatactctggaaaaatgagatgtaagtaggtattttgtattttttagcgtttcaagagcataattccccttatggtatgtctgttgccttgctttcacacattccacttgtgtacatgtttttgggaactcattatgtaagaaagtaatggacttcttacacttctgttaggtaaaaccatagtaattggctgggcatgatggcatggggtgggaggatcacttgaggacaagagtttgagcttgcagtacactgatctttgctgtgaatagtcactgcactccagccggggcaacgaagacactgtctctttcttttttttttttttttttttttgatggagtcttgctctgtcgcccaggctggagtgcagtggcacagacttggctcactgcaacctccacttcccaggttcaagggattctcctgcctcaggctcccaagtagctgggactacaggtgcctgccaccatacctggctaatttttgtatttttagtagagacggggtttcaccatattggccagactggtctcgaactcctgaccttgtgatctgcctgcctcggcttcccacagtcctgggattacaggcgtgagccaccgtgcctggcccaagactctatctcaaataaaaaagaacacagtaatttttctcttttatgggatactacacttacataagtttcttttttttttcttttttttttttttttgtgagacagagtcttgcttttcccctgccaggctggagtggagtggcatgatctcagtcactgcaacctccgcttcctgggttcaagtgattcccgtgcctcagcctcctgagtagctgggattacaggcgtgccccaccacgtctggctaatttttgtatttttagtagagatggggtctcaccatgttttcccaggctgttctcaaactcctgagctcaggtggatcccccctgcctcggcctcccaaagtgttgggattacagtcgtgagccactgtgcctgtctgggatgtttgccatatttgtttcatcagtatatatttctttgcttgggttgagtacagggactgatgcctgtaatcccagcacttagggaggccgaggtgggaggattactggaacccaggaagttgaggctgcagaccaacctaggcaacagagtgagaccatgtcttcagggggaaaaaaaaagcgctgggcatgggcatatacctatagtctcagctactctggaggatgaggtgagaggatcgcttgagcccaggaatttgaggctgccatgagccgtcatcatgcccatgccaatgtactccagcctgggcaagaaagtcgaccctgtctcaaaactaaactaaacaaatttctctggctgaagtttagtaatttgcttttaagtgacgtttgtacattttagaaaataactttgtatattagacatcatttatggtacttaccgttttccatggtcataaaatacctagtctagtgtgataaatgccaggtgatagaggtatgcctggggcataaacctaggggcttggtgggatggggtgagatggttgaaatagtatgtagaaggaaaggctttccagagtttactcttagggtggctcttgaagggcaagtgaaggaaagacatttcaggctgagggaagacacgtttagatggagtcctgtggatggagagtgctggacttgtttgcgaagtcaggagtagtttgatatgatcagatgcttagggaggtgattggtaaagtggtggaaggtgagattgtggaacaggtaggcatggaccctatcacaagcgtcctggcttgtgtatctagctaaaggatctgtctgtctgtctgtctgtctttatattttttgagacggagtttcgctcttgttgcccaggctggagtgcaatgatgcaatcttggttcattgcaacctccgcctcccaggttcaagtgattctcctgccttagccttctaagtagctgggattgcaggcgtgcactacacgcccagctaactttttatttttagtagagttggggtttcaccatgttggttaggctggtcttgaactcctaacctcaggtgattcacctccctcagcctcccaaaatgctgagattacagatgtgagccaccccacctggcccatgcctctatctatctatctgtctgtctgtctatctatctattctatctaatcttttttttttttttttttttttttggagtcaggttcttgctctgttgcccaggctggactgtagtggcgtgatcttgcctcactgcagcctctgcctcccgggttcaagcgatcttcctgcctcagcctccctggtagctgggactacagatgtgtgccaccatgcctggcaagtttttatatttttggtagagatggggtttcactatgttggccaggctgatctcaaactcctgacctcaggtgatctgcccacctcagcctcccaaagtgctgggattacatgcgtgagccactgtgcctggcctgttaagtattaccataaactcttctcctatctgtcttgtaagttatgtacacctcatctatgttcttgatgtagcttgttacttagtctgttatagtaataatctctttaattattagcttttatgtcttctccattgtccactgacagccataactgcgtatatctttttgtatacctgtctacagaccagccatcctaggttgaagaatagaattacttctcattgcttccacagttcctgtcttcctttaaatcatcatgtataacacaaattatacagtagctttcttgtaaatctcctgcttctgtattttatatctgttaggctgggtgcagtgactcacttctgtaatcccagcactttgggaggccaaggtgggaggattgcttaaggccaggagtttgagaccagcctgggcaaaatagggagacaccccgtcaccacacacttatacacacacacacacacccccccacacccaccatgaaaaaaattagtcgcggcggggtgcggtggctcacgcctgtaatcccagcactttgggaggccaaggcaggcagatcacatgaggtcgggagttcaataccagcctgaccaacatggagaaaccccatctctactaaaaatacaaaactatctgggcgtggttgcacatgcctgtaatcccagctaccctggagtctgaggcaggagaatcacttgaacccgggaggcagaggttgtggtgagccgagatcgtgccgttgtacttcagcatcaacaagagcgaaaccgtctcacaaaaaaaattagtcgggcacaatggtatgcatctgtggtcacagctatttgggagactgagctaggaagattgcttgagctcaggaattcaaggctcagtgagctctgattgtggcactgcactccatcccgggccacagagactctgtttctaataaataaataaaatgtaaattagctgttcctctgtggcttacaaccttccagtggctcccatttcacttagagtaaaagtgaaagccctcaccgtggtcccctccttttttgctgctccattactctttctttatctccttcacttcattcagatcattgctcaataaggcctctcctaacctacctatctgcaagtatctctagaatatgacttaaaaacaatctaaacacagatgtcacaactaaaaaaaattaatacttagtccttagtgtcattaaatttctggtcacctattgttaaatagttgctttgtttgaaggtcactgcaacctgcatttcctgagcccaagctatcctcctgtttcagcctcccgagtagcagagactacaggtgtgcaccaccatgcccagctagttttttagaattttttgtagagacaggatctaactgcgttgcctaggctggtcttgaactcctggcctcaagtgatcctctcaccttggcctcccagtatgctgggattacaggcacaagccactacatctagacacgaatttctgatttaaataattctttgtaagaacacttcttaggaggcatttgaatggataactgtcttaactgtcttgcacaccagtctttgtcttttttttttttttttttttttttttgagaaaaggtcttgccctgtcacccaagctggagtgcactggtgcaatcacagcttactgcagccttgaactcctgggctcaaatgatcctcccaccttggcctccaaagtgtttggattacaggcatgagccactgagcccagcctcaggttgtctttctcctgctttactatttcatttttttcttttcgtcttctagcgtactgtaaatttacatatattttaatgtctgtactagaatataagctcaacaagggtagggctctttgtgtgtagacattgctcagtacatagttggcacgaaataaaatcacttaaatgaatgaatgagtgaaatacaaaggcggaatttgactgtaaaacagtcttgttggagaaggtatatggggaataggggaaagagagggcctcttttcgccctcctacattgatacagatagatctcagttggtctctgatcttgtttgtagggattttgttggatgaatgcaaggtgggatggtcttcagattgtaccaatttagctggcattgctaaccaactgttggaatctctgaaaataaaagatcttgaaattcctccccctctccccgcaaagagaaatacgaaggcagacaactgggtaaattgtcctacccctaactgccatccacagaaaagtaacattttgttttatttgattaactgtgcttgacaacattagaaacagtggaaaatcatctgggacttgggcaggtagaaactccagaggtaggactggaggaggggctgtgtaacctctctttcttactcttaagaataacctttttatctacccgagatttattggctccttaaaatcataactaaaacctgtagcctctttcagcagaaagcaatgcttagagtaagacttctactacactgccagcccgaaggcttgaacagaaggcaagtggaagccctaaaactttggctgttcctggcacgattccagtcccactctccctaccctcacccacagcttccccatcactgtctgcttgggaaccgtgagcattgttctcatcttgtgcttctttctgagttatcaggcagccggaaggccagattcccttgtcttccctcttttcatggactctgcattttcttttctgatcctgtttttcaccttgatcttcttggaacttttccctgagcccttttaaactcacggtatatcagcaaaattcccctaatcttcagtttcttctgtgatttccgccccccgccccacacattcttattctgactgaaaataggccatctcctgatgacactgcctccctgcagccctccgaaagagtacttgcctgcccctccatcccttttgtgttactaggcttcacagtagcatgtcctctttttctttgttgccatttctttacttttcttctcgcctccctaaaaacacctctgaatgtgatgtcatgagtttgtactatgcgctcctgatttttgctgcttaatccagtgtgctgtggaggattgaacctcttatgatggagttcccctctttaactctagtaatgcttcttgccttaaagtctgctttgtctaatatcagtatagctatgccagttttctttttgttcgtgtttgaatggcatctttttctgtcttttttattttcaacctttctttattcttgatgtcttggttatgtctgaacaggttttcatccacatcttaaaagcacatctttgcttttaacttgcatttagtttcattcacagtttcatttaatgtatttattgatatatctgtatttagatctaactcagagatttctatttgacccacctgttctgtgtgggtttgttttgttagtccttttgatcttcctttgcattgatttagtatttattgttattcttccctcttccttagcttggtaattgtgtgctatttggaaaaaatactattctctgagtagttatcctagagataacaatttacttcctttatttatttattatttatttatttatttatttatttatttatttattttgagacggagtctcgctctgtcgcccaggctggagtgcaatggcgcgatcttggctcactgcaagctccgcctcctgggttcacgccattctcctgcctcagcctcccgagtagctgggattataggcgcccaccaccacgcctggctaattttttgtatttttagtagagacagggtttcgccatgttagccaggatggtcttgatcccctgatctcctgatccacccacctcggcctcccaaagtgctgagattacaggcgtgagccacagcgcctggccaacttccttaatttattaatctcatgttgacttggcttctcaagaaggcttaagaatcctaaagggaagctgggtgcggtggctcacgcctgtaatcccagcagtttgggaggccgaggcaggcggatcatgaagtcaggagatcgagaccatcctggctaacacggtgaaaccccatctctactaaaaaaaatacaaaacattagctgggcatggtggcgggcacctgtagtcccagctacttgggaggctgaggcgggtggatcatgaggtgaggagatcgagaccatcctggctaacatggtgaaaccccatctctactaaaaaaaatacaaaacattagctgggcatggtggcgggcacctgtagtcccagctacttgggaggctgaggcaggagaatgacatgaacctgggaggcggagcttgcagtgagctgaaattgcgccactgcactccagcctgggcgacagagggagactccgtctcacataaataaataaataataaaataaggctgtgcatggtggctcacggctgtaatcccagcactgtgggaggccgaagtgggcggatcacctgacgtcaggagttcaagaccagcctggccaacatggtgaaaccctacctctacaaaaaatatacaaaaattagctgggcgtggtgccacccacctgtaatcccagctacttgggaggcttaggcagagaatctcttgaacccaggaggcagaggttacagtgagccaagatcatgccaactgcactccagcctgggcatcagtctaaaataaataaataaataaaattcacacctaggacatcacaataaaatagatcgcttgagcccaggagttcgagaccagcctgggcaacctggtgaaacactctctctacaaaaagtacaaaaattagccaggtgtgatggtgcgtacctatagtcacagctacttcggagactgaggtaggaggaacacttgagcctaggaggtcgaggttccagtgagctgagatcttacccctacactccagcctgggtgataggacgagaccctgtctcctcctcagaaaaaaaaaaaaagcattacttaatctcttagcctcttaatggccccctctggaataggcaaataagggggaaactgtgggggaaagcccaatacctacacttcccttttgttttttctggaagtcttcccctttttccccagctggaatgcagtggcacaatcatggctcaactgcagccttaatcccctgcgctcaagtaatccttagcctcccaagtagctgggactacaggtgcatgctaccatacacctggctaattaaaaaagaaaaattatttttgtagagataaggtgttactgtgttgcccaggctggtctggaactcctcacctcaagggatcctcttgcctgggcctcccaaagtgttgggattacgggcgtgaaccactgtgcctggcctgaagttccctttctgaaggcagcagtctctcttgcattccaggtctatcttgttacttttttttttttttttttttttttgaggcagagtttcactcgttcccaggatggagtgcaatggcacgatcttggctcgccgcaacctccacctcctggattcaagcgattctcctgcctcagcctcccgagtagctgggattacaggcatgcgctactatgcccggctaattttgtatttttagtagagacagggtttctccatgttggtcaggcttgtctcgaactcctgacctcaggtaatctccccgcttcggcctcccaaagtgctgggattacaggcatgagcaaccgcgcctggctttttttttttttttaaatagagacagtgtctcactatgttggccaggttggtcttgaactcctggcttcaagcaatcctcttgcctcagcccctcaaagtgctagattacaggcatgagccattgtgcccagttgttacttttctgattccttcaaacagatgttaatattttgttcactttttccagttgttctgtagtgggaggggtctgaatgacttggtttcctagaagggaagtaggtagtttctacctttctgttacgtagtctagtataatttctgtgtcttttcttatttcagtatgcctaatgatattcttcccagagccgctgtgaatgactgcataggttgaacacaacaacacagtgaccctaatccttccgataccttggcttcttagttccttgacctctattcctgggatcctgttctctgccctacctcagccacccattcctttgagttactgttacctgaaattcatacccttttatctctgtttcagacttagcactctacatcctcctgatctttccagctgatgcccttccagcatccctgtgatctttgactccatcatgacgtcagttcattgattataccaccttttcccttgatgtttcttacgcttttgttcagcttaaattccagtcattagaacacaacctctcctcctattcctttgtcttcttgtttcattagttcttttggctatgccacaacctgtgttttactctcattccccggaaaatagagcatacaacaaagcttttactgggctaatactttacttgaagttagaatgaaggggaaaatagaaagtgagacaggaaaggagggaaagcaaatacagagtgctacgttatccagcaggctacagcatcataagaaccttagctggctgctcagtcatgttggaaatctctggagaatcatggcacctctcagaatacttctggggacaggtttgagggaggatggctgagagatttatttgttggctccctctcatatcctgtctcttactggtcagagttgcctgaaggatcttaattattctatacttttgggtttgttacttggcttctctatgcagctgctggaaaagcagctgatttggggtaacagggcttctgccacagcaggcacagtgaggaccaccaaagcctacctgttaacactggggaggtagagaccactagtggtaggctgagttcatatgatcctcccagattgcaggattttgcttgtgctgctgagcctgcttcagctgggaagtagaacagcaggcaggaccgagtggattttggaaagtgtgtatgagctgcatttgttataccttgtgtaatccaactttttgcctattctttgcttgctttcccatagctcaatgtggctggagaaaccatactgatcactctgacttcacagtcatgattaccaagaccaagaggcttttattataggttatagtctgttttcctattccaattactcttctagatagtttaaatgtcttactttaatcctctaattctccctgccttatcctccctttatttcattggggaaaaaacctgaatcaattagaagaaaactactcactccccttaccagatgtgctacctgtctacatctgtgcctggtactctgccttctgtaactgctagctaaggccaaaccctgtgcacgtatactaggctccatgcttttctacctgtttaaggataatcactccagtagttcatcctttatttgcatcatcaaatttttcatctctgttgtatcattcttatcagcgtattaaacgggctattacttcttgtttaaaaacttttttgccgggtgtggtggctcacgcccgtaatcccaacactttgggaggccaaggctggcggatcacctgaggtcaggagattgagaccagcctggccaatgtggggaaaccccatctctactaaaaatacaaaaattagctgggcgtggtggcgggtgcctgtaatcccagttactcaggagactgaggcaggagaatcgcttgaacccgggaggcagaggttgcagtgagctgagattgtgcccctgcactccagcctgggcgacagagtgagactctgtcttaaaaaaaaaaaaaaacacacacacacaccaaaaaaacaaacttcttttggttattctgattctgtatattctttcttttctcctattcttttacacatttcattcaggcttttgcccccactgctcctctagagttgctcttgaggtgatcaattgctccatgttgctaaatccagcaatctgtttgcagtcttcaccttatttgaaatatctaacccaagagacatatgtgtctgtgtgtgcgtgtatatatatatgtatataatatgtatgaagggtttatatatgcataaatttaaaaggggtgtgtgtgtgtgtgtgtgtgtaaaattgaccgacatgactgtgaaggccaggaagtcccaaaatctgcagctggcaatctggaatcccgagatagctgacagggtaagttccagttcaagtccgaaggcacgagagccaggtgagccagtgtctcagctcaagcagtgagacccagaggagttccctcttaaactcagcctttttgttctcttcaggctttctgtgggttgtatgagtcccacccacattaaggagggcagtctgctttactcagtccacggattcaaatgttcattttatctgaaagcactgtcacagatagacccagaataatgtttgaccaaacatctgggcactctatgctgtagtccagttgatgcataaaattaaccattacagaaccttttcttcacttgacatttagaacaggatgccaatatagtccctataagagctagtccctggcttcagctccactacccgctcccccgcttttctctctctctctctcttttctttttttgtttttttggagactgagtcttgctctgttgcccagtgactcactgcaactccaaaaaaaaaaaaagccttactaataaaactcttagcctcttagtggatccctctggaatgggccaataagggggaaagcccaatacctgaacttctcaatgaaaatcctgggttcaaacaattcttgtgcttcagcctcccgagaggtgggattacaggcacccaccgccatgcccggccaatttttgtatttttagtagagacggtgttccaccaagttggccaggctagtctcgaactcctgacctcaagtgatccacccacttcggcctcccaaagtgctgggattacaggcgtgaggcaccacgctcggcctccccttttctctactgcagtcagaggtgccaacttgctctttttttttttttttttgagacggtctcgctctgtcacccaggctggagtgcagtggcatgatctctgctcactgcaaactccacctcctgggcccaagcgatcctcccacctcagcccctccccaagtagctgggactacaggcgtgcgccaccacatgcctggctcatttttgtattcaacacgctgtttcctgaccgtagctggataggcttctgtgttgggggctttgcactcattcatctgcctgaagtgcctccttgctgctgggcacctcctccccatccacatagcccatggccttattcttgccacgtgtactgaaatgtgacattctcatgagggttttcctcatcagtctgtctcagttttcagctgcatccccggcacttcctgttccccttccttgtttttcttttttctcatttactcttatcgtcatctaacacacttccttatttatcttgtttattgtatgattccttcaactagacggtaaactgtgaggtgagaggagagctttttaaaatcttgttgccttaacagcctcccccccccccaccactgcttctagaatagtgcctggtgcaaatttgcctctcagtaacaagttttctgtttatttaaaaatacggacggaatttcgaagctttgtgatagagataaaaaaaatggacaggagcttttcccaggaggtatacaaagtataggtgtctggcctggaactctccacaaagaatacctttattgctctacaaatgctatttgtagtctaaacatggatgagctgatacaattctgaaggcaccttgcagccttctctccttgcttctagctccacgtgtgtgcgagtctgcatatgtgagtgtaagggcagcactgtgttaaagagatttacaaacatctttttaatcctcataacaatcctacaccacacatgtcatcatcccctttgtacagaccataaaactgatatttagagagcttaaacgtcttgcttgaggcctcaagtggtaagtggcagaactcagcttgaagtgacttgactattattacattatatgtgacctcctagataaagagatgcctccttattttgtgtaaggcagaagtggggagtcttgggcagattacttaaccactgctatagtttggatgtggtttgtccttagcaaacctcatgttgaaatttgatctccagtgttggaggtgggccctaatggaaggtgtttgtgccatggggctggaaccctcataaatagattaatgccctcctgggtgaggggtgagtgagttcttactcctttagttcctacaagagctggttgttaaaaagagctggcgcctctctcttgctgcttctctggccatgtgacctcttcacatgctggctccccttcaccttccgccatgtgtggaagcagcctgaggctttcaccagatgccccatcttccagccggcggaatcatgagccaagtgaatttcttttctttgtcagttacccagtgtcatgtattcctttataggaacactaaagggactaagacaacccctttaggtcctaatcatatacatacttatagattcaaagtatctgcttagcatgtactccattcaaagcaactgttcaaaggtaagaatcctatcagggatcagtgcagaaatacgacaccttacacatttctcagctttcaccttcccagagcttcctcggattggtcctcctgttagtttcctggatctgaaggtaatacctcatccagaagataagaagggtagtggggactgtcaccacgaaggagctttccttttctggttcaagttatttcccagctccactcacctccggactgtttcatgaagaattccagaagtccccttctccctcataggaaagtgcaccgaaccactcagatttaatggcttaaaacaactgctggtatttgaggatttgttcaggtgggcagttgtggttctgggctaatgggggccggtgtcatctgcttgctccactgtgatctggaacagctgggccttttttcttggttactgtgtagtctcacgacctctccttttccagtgaggtctgcagtaggacctgatggcttatgcagtggttcagggcaaacattcccagaggaaggaaacagaaactgccagttctttttgaagtgtaggcccagaactggtatatcatcacttctgtcacatttccccgatgactttgtgtctctgaccatcccaaactcactgtgagaagtgactgcatggggtgtgggagtaggtccattgggagtggactagtccagaccttttttttttttttgagacggagtcttgctgtgtcgcctgggctggagtgcagtggcgcaatctcggctcacggcaagcctcgcctcccaggttcacgccgttctcctgcctcagcctcccgagtagctgggactacaggcacccgccaccatgcccagctaattttttttttttttaagtagagacggggtttcaccgtgttagccaggatggtctcgatctcctgacctcatgatccgcctgccttggcctcccaaagtgctgggattacaggtgtgagccatcacgcccggcccagtccagactatttttgagaataaaaaggggcctattaaaaattatgtcaggttgacagacataaactggaactgtcctcacctagtctggacatgtgggtatcattatcatctctacaacttggagaaaacaacacataggtgtgaccttgaatcttgaatctgttttcctgcagttctcctaatgtgaaaatgtgactgcattgagtatgcatgtgatgttttaaattgaatatagcttctaagcagaacccatcaactcttcttttctgttctgttctttacttttctttcttttttttcttttctttttttgagacagggtctcactctgtcgaccaggttggagtgcggtggcgcgatctcgtctcactgcaacctctgcctccagggttcaagcgattctcctgccttagcctcccaagtagctgggactacagactacaagcgtgagccaccacgcccagctaatttttttgtatttttagtagagacggggtttcaccatgttggccaggctggtcttgaactcctgacctcaagtagtctgcacgccttggcctcccaaagtgctgggattacaggcgtgagccaccgtgccgagccaccatcagattttcttggtgggcactgaatgatgacagaaagagtttaatttaacactggagggaaaaattggctttgaatttcctgagaaataatttcgtttgttgggttttttttttttttttgagatggagtctcgctctgtcacccaggctggagtgcagtggcatgatctcggctcactgcaagttgcgcatcctgggttcacgccattctcctgcctcagcctctccaagtagctgggactacaggcccccaccaccacgcccggctcattttttgtatttttagtagagacggggtttcaacgtgttctcgatgtcctgacctcgtgatctgcctgcctcggcctcccaaagtgctgggattacaagcgcgagccaccgcgcccggccagtttgttggtttctaatagagagctttcctgaaggatttttcgttcttttttcttttttcccccctgcaaggggaatttttcaagactgattttgactgcatgctatcctttcctttcctttcctttcctttcctttcctttcctttcctttcctttcctttcctttcctttccttttccttttccttttcctttcctttccttttcctttcctttcctttcttctcccctcccctcccctcccctcccctcccctcccctcccctctcctcccctctcctctctcctctctcgtctctcctctcctctttcttttcttttttttgagacaggatctcactctgtcacctagactgagtgcagtgaagtgattatagccccctgcagcctcaaactcctgggctcaagcagttctcccacttcagcctcctgagtagctgagactatttgtgccactacatctggctaatttttaaattttttttacagatgggggtctcactgtgttgcccaggctgatcttagactcctggacacaagccatcctcctgcctcagcatcccaaaagtgctgggattacaggcataagccactgtgcctggccagctgttttcaacctatatgctgacctggatctaatcctctcataagataaaatttcactctgctgattaatcagatcattttaaaggtctcatctagctctaagagactctaataatccaatagaaagtggttacaaacaccgaaagtacaattgggaagatataataaaggctttcacagttcatatgtgatctggggtcagatgggattcaggaaactccatactttgtgtttttctaatattaaaaaaatttttatatagagatggggtcttgccatattatattgcccaggatactgttgaactcccaggctcaactgattgtccctccttggcctcttaaagtgctaggattacaggcttgagccaccatgcttggctaccccataatttgaaggagagttagttgcaattaaaaatggaggtttttttttcttttctctttgagacggagttttgctctgtcacccaggctagactacaatggcatgatctcagcttacagcaacttctgcctcccgcattgaagcgattctcctgtctcagccttcttagtagctggaattacaggcgttcgccaacacgcccggctaactttgtatttttagtagagacagggtttcaccatgttggccaggctggtctcgaactcctgacctcaggtgatccacccacctcagcctccccaagtgctgggattacaggcatgagccaccgtacccagtcctggagtttgttcttaacagaatatcaaatcttgagaagttgactataaaagaaaattctaaaattaaaaattctattctctgtataatacatagaaggtagatttttgaggtatgacatttaagatgtgaggtgcctctaaaatgtacacatacatgcttgtgtactccacgtaattgtgcctcaaggaggtagggtgaggctttctgtctttcctgaaacatgttactcttgttcagtgcttggaaaaaggatgtggttagatggagtactggcttgatacaattctctgtcttgcccagggttgagggtggtgtcaatgaaaattctcaatttgaatgccatgtaataggctccttattaatcctgactacagtataaaaaacaggctgggcttcatggctcacacctgtaatcccagtgctttggttggccgaggcaggagggtcactggaggccaggatttcaaggcttcagtgagctatatgattatgccactgcactccatcctgggtgacagagcaaaaccctgtctcaaaaaccaaccaaccaaccaacccgcaaaaccaaaacagatctctccaagcttcggcagatttgagtaattatgtgatctcttcttgactgaacaagtcacttgtcagatgaatatctggttcccactatctagggacagaaggttcccactaacattgatttcaggtaatgcataacaaataaatactaagttttttgacatctttccacaacatgtttatattacgtgtgtgtgtgtatgtatgtgtgtgtgtatgtgtgtatatatatatatatgtatatatatatacacacacacgtacatacatatatatatgtgtgtatatatatatattttttgggacagagtcttgctctatcgctcaggctggagtgcagtggcgcgatctcgactcacgacaacctctacctcccaggttcaagtgattctcctgcctcagcctcctgagtagctggaattacaggcacgtgccaccatgcctggctaatttttgtatttttttttttttttaagtacagaaggggtttcaccacgttggtcaggctggtctcaaactcctgacctcaggtgatccgcccacctcggcctcccaaagtgataggattacaggtgtgagccaccatgcctggcctttttttaaagagatggagtctggctgtgttggcctggttggtcttgaactcctggcctcaagcagtcctcctgccttggcctcctaaagtgctaggattacaggcatgagccattgcacccagtccaatgtttcctagtttttcttatgcaaacttttaaattcttctcagtatatatgtctaaaatcttctgttacaaaaaaatactgaagctgctgcacacggcggctcatgcctataatcccagcactttgggcggcccaggcgggtggatcacttgaggtcaggagtttgagaccagcctggccaccatggtgaaaacccatctctactaaaaatacaaaaagtagccgggtgtcatggcaggtgcctgtattcccagctactcgggaggctgaggtgggagaactgcttgaacccaggaggcggaggttgcagtgagctgagatcactccactgcactccagtctgggtgacagagtgagactttgtctcaaaaaagaaatggaagcaatgtatatttattaaaatatgtatatacatatacagaaatgagctaaaagtagctatattattattaaaattgtatgcaataatgattgcatagcatgttggtatgaatatgaccataatttgacgcaagttgacacatttttttttctaatattctgtattacaactaatctgcatggattgtttttctgcatgtaatctctgcttacttggtttaactttttggtcgagtcctggaagtggaattggtgaattaaaaatttagatataaactcccaaattgagccaggcgtggtgtcatgcacctgtagtcctagctgctaaggtgggaagatcacttatgcccagcaattgcagtgggctatgattgagccattgcactccagccttggtaatgcagtgagaaacataaaagtttctccctccctccctcccttctgacagagagtctcactctgtcgcccaggctggagtgtagtgtcaccactgcaacctccgcctcccaggttcacgccattctcccacctcagcctcctgagtagttgggactacaggcacctgccaccacacccggctaattttttgtttttgtatttttagtagagatggggtttcaccgtgttagccaggatggtcttgatctcctgacctcgtgatctgcccgccttggcctcccaaagtgctgtgatgataggcgtgagcaaccacacccggcagtgagaaactgtttctaaaaaaaattttttttaacgtagaaatcttttcctttttttgagatggagttttgctcttgtcgcccaggctggagtgcagtggcgtgatcttggcgcactgcaacctctgcctcctgggttcaagcgattctcctgcctcagcctcccaagtagctgggattacaggtgcctgccaccacaccccgctaactttttgtatttgtttactagagatagggtttcactatgttggccaggctggtctcgaacttctgacctcaggctatttcttcccccagggcctcccaaagtgctgagaatacaggtgtgagccactgcgcctggccatagaaatcttttcatatgtttgtagatcattcttctttgagtattctctattttttaccttcacccgttttactgagtttcttattggtttataagaattttttttgctgggtgcagtggctcacacctgtaatcccagccctttttggggccgaggcaggcggatcacctgaggtcaggagttcgagaccagcctggccaacatggtgaaacccccgtctctactacaaatacaaaaattagctgggcatggtggtgcacgcctgtaatcccagctatttggaagactgaggcatgtggatcacttgaacccgggaggtggaggttgcagtgagctgagatcgcaccattgcactccagcctgggtgacaagagtgaaactctgtttcaaaaaaacaaaacaaaacaaaacaaaactctttgcatattgaaggaacttactagcaagccttttgacatagactttgtaaatgtttttcttttgatgattatatatatggttagtttggctgtgtacaagttttttttgtttgtttgtttgtttttttatttttttttttttgagacggagtcttactctgtcgcccaggctggagtgcagtggcacaatctcggctcacggcaacctccgcctcctgtgttcaagcgattctcctgcctcagcctcccgagtagttgggattacaggcgcccgccaccatgcccagctaatttttgtatttttagtagagacggggttttactatgttggtgaggctggtctcgaacctcctgacctcagttgatctacctgccttggcctcccaaagtgctgggattacagacttgagccactgcacctggccgcatatatatattttatttttttatttaaaaaaatgtttctgagacaggatctcactatgttgctgaggctggagttcagtggtgtgatcatggcccaccgcagccttggcctcctgggcttaggtgatcctcccatctcagcctcccaagtagctaggaccacaggcaccatcgtgcttggctaatgtttagtatttttttgtagagtcgagatttttgccatgttgcccaggtagtctcgaacttaggagttcaaaacgatttgcctgccttggcctcttcaagtgctgagattacaggcttgagtcacctcacatggctgcaaagcgattttttttgagacacatttagttttttcggtgatgtcagtaattttacaattaaagaaaaagttatctgaacaaagggagagtgcccttaaattgctaagagggagcattgctttgtttttttctagtttcgttgtgtcttacagtgttcaaacactgtactggaagtaaataattaagtttaaaataattttcttctccagtgtttgattatccatttctttttgttccaatttctgtatctgaaaaacaatattggcttcaaaaacgaacaaaaaaaaatttaacttcccccagattgcagatttaccatgtaaatgtgtttccaccctgttttcaagctaatgtgacaaatttgctacattataaagaacagaaacctgtgtacagattttggggatagcacacataaaatagtccaaggacattatcaactcaggtgcagaagttcttgctgaagttctattaacaattgtgtttaaaaacaccagatgggagcagatttaaagagggagattctaatggaaggttagttgggatttgtagggaagagagagaaggattttaattgaaaagatactagaccgtattcttacctttatagcgttgtcttcttttctttcttttctttttttttgagtcatattttcgttcttgtcacccaggctagagtgcagtggtgtgatctcggctcactgcaacctcagcctcccgagtagctggaattacaggcccctgccaccatgcccagctcatttttgtattttcagtagagatggggttttgccatgttggccaggctggtctcgaactcctgacttcaagtgagctactggccttggtcttctcaaaggttgggattacaggtgtgagccacctcgcctggcctatagtagtgtttttttttcttttcttttctttttttcttgagacggagtcttgctatgttgtccaggctggagtgcagtggcacaatcttggcttactgcaacctctgcctccctggttcaagcaattctgctgtctcagtgagtagctgagattacaggtgcgaaccaccacatccgggtaatgtttgtatttttagtggagacggggtttcgccatgctggccaggctgatctctaactcctgatgtcaggtgctccgcctgcctcagcctctgaaagtgctgggattgcaggcgtgaactactgtgcccagcctagtagtattttctatccaagttttggatgtaattctcttgggatttttttcctaatttgtacagctaccactgtactgttcatgactgtatccatgggaacataagtaggatgacataagtttataacttgttgctaggcagatctagcttgtaatgtattaagattttcccattaaaaagcatttggatggttttcttttgtgcggtgaaggtaactaaacagcgtaatttggaattaaaactgtgaagttgtataaattccttctaggagaaccaactactctttgttttctttctttcttttttttttttttttttgagacaagatctctttttgtcacccaggctggactacagtgacatgatcaggtttcactgcagcctggacctcctggacacaaatgatcctcctacctcagccttctcctcccctttaccagctcctccccttcccttccccagctctccccctccagtagctgggaatacatgtatgcatcagcatgtctggctaattaatttattttttaatttttatttatttatttatttatttatttatttatttatttatttatttatttattgagatggagtctcgctctgttgtccaggctggagtgcaatggcgtgatcttggctctttgtatcttcctcctcctgggttcaagagattctcctgcctcagcctccctagtagctgggattacaggcacctgccattatgcctggctgatttttgtagttttgtggagatgcagtttcaccatgttggccgggctggtcttgaactcccagcctcagaagatctgcccacctcagcctcccaaagtgctggggttacaggtgtgacactgagctcagcctattcattcattcattcattcattcattcattcatgagacggagtctcgctctgtccccaggctggagtgcaatggcatgacctcggctcactgcaacctccgcctcctgggttcaagtgattctctgcctcagcctcatgagcagctgggattacaggcatctgccaccacacccggctaattttgtgtttttagtagagatggcgtttcaccatgttagtcaggctggtcttgaattcccaacctcaggtgatccgcctgcctcagcttcccagagtgctgggatgacaggcgtgagccgccacacccagccatatatatatgtattttttatttgagtttgcgttttgccgtgttgcccaggctggtcttgaactccggaatttcagatcgcccacctcagcctcctaaagtgctgggagccgctgtgcccagcctagtcatgtttttaattaattgaatgtctgaaatggaagataatgagttaaaataattgtgtcttaagcctgtcctcttcagctaaaacagtcagtatttagatatgtatgaacgagatgtgaacacttgatccatcctaaagtacatagcagatttcaagatgatgacaggtatcttgggtagttcttccgactctcaaagacttggtggactaaccaagaaaacctcatggagatcgagacacctgtcttgtattttggttgcaattttttaaaattaatttttaaaaaatgtaatattagtgtaaaataactaaatttcaaaaaagtttagaatgagatgtaattgaggtcacatagctcttttctgcagaggctatcacacttaacaccttatctgattgtaatttaaagaattttttgaggctggacacgttggctcacgcctgtaattccagcattttgggagactgaggtaggagggacacttgagcccagcctgggcaacatagtgaaaccccgtcttacagaaaattaaaaaattagctggctgtcgtagtgtgcacctctggttccaggtactttggagtctgaagtgggaggatcacttgagccagggaggttgaggctgcagtgaactgccattgcactccagcctgggtgacagagcaagatccctgtctcagaagaaaaacagaaaagaggctgggtgtggtggctcacgcctgtaatcccagcactttgggaggctgaggcaggtggatcacgaggtcaggagatcgagaccgtcctggccaacatgttgaaaccccatctctactaaaaatacaaaaaaaattagctgggcttggtggcgcgtgcctgtggtcccagctacttggaaggctgaggcaagagaattgcttgaacccggaaggtggaggttgcagtgacccgaaattgcaccactgcactccagccttgcggcagagtgagactcggccttaaaaaaaaagaaaaccagaaaagaattatgtaagcagttattcaataataaataatatttatgcagctgggcacagtggttcacacctgtagtcctagcacttttggaggctgaggcgggtggatcacttgagcccaggagttcgggaccaacctgggcaacatggcaaaaccccatctctacaaaaagtacaaaaattagccggttatggtggtgttctcctttagtcccagctattcaggaagctgaggtgggcggatcacttgtgcccaggaggttgaggctgcagtgagccaagatgtcgccactgcactccagtcccaacaacagagtgagaccctgtctcaattaaaaaaaaaataataatatttatgccgtttttttgtaccagctactatgataggtgctttataggacaatttggggaagtaattgctgttaactccattttactcatataaggaaagtgacgcttgcacaaggtttaatatttcttgcccactaacatgtatgcttcaagaaagcaggggctatgtgttacttctgtctagccccctcctgtatctagcatagtttctttggggtttgggtagtgtgtcaaatacagtggaaaggctggttttacaaagatgattgttgtatcttcatttattacctttgaacttgtagcttcatagggaaatcatgggaatttgagcagcactgaatctgcatgtattaaaaaaacttgcatcatttctggatttcatgtggtgaatatttgatagtacctctcgtgatttgataaggtccattatttggggacaagggtggttaacatagggattgatggaattgtgactccattctgttgtggcgtgtttagtttttacctctttccctttactcctcgtgccccagctgcgtctgtgtccattgtcctttcagtttcttactctaattgaaagaatacataggtaaagaaggaatctgatagaaggaataaacttctttgacggtattaacaagtgtctgatcttgattagtgtaagttgtattcagtgcctcatgtttcttacctttgaattgtagaaaataaaattttagatctggttaagattcttgagattatttggcaggaggaaattgaagcgcagttcagttccatagaatgttgttgaatgcgtttcttcatttgttaagagtgataatatttgtctcatagggttgatacaaggaggaagagatactctttataaaaaagtcttaggccgatttgatgataatactaatagttaaacttgttcagaagttaatctgggctgggcatggtggctcacacctgtaatttcagcactttgggaggcagaggtgggaaggatcgcttgagcccagaaattccagaccagcctgggcaacaaagtgagacctcgtctctataaaaattataaaaataagccgggtatggtggcacatgcctatggtcccaggtactcgggatgctgagatggaaggatcacatgagcccaggaagtcgaggctgtggtgagctatgatcattgccactgcactccagcctaggtgacagagtgagaccctgtctattaaaaaaagttagtctgtgttagcatagtatcggcagaaaagtattctgacacagtataggagggatcagggtatgggggaatgagtcaggaaggccattttaaagattttacagtgtcctaaacttgatagtgaaggctaagcattagaaatggaagagattggctgggcgcagtggctcacgcctgtaatccctgcactttgggaggccgaggcgggcagatcacgaggtcaggagatcaagaccatcctggctaacacggtgaaaccctgtctctactaaaaacacaaaaaattagccgggcgtggtggcgggtgcctgtagtcccagctacttggcaggctgaggcaggagaatggcgtgaacccgggaggcggagcttgcacagtgagcccagatcatgccactgcactccagcctgggcgacagagcgagactccgtctcaaaaaaaagaggaatggaagagattagaaaagatgtgaacaaaccttatagagcttccaggaaaggaagaaaggtaaaaacattgagatttggaatgttgagtaatgggatagtataaacagtatagcagtatagagatgtcactaatgttttagaaactgaaataatagattaatgcatggtaattaccttgccagaactgaaaagcggtggtagtgatgctggaggaagcagattgctgctgcagaactgcagcaaggcctaggaggtggaggcaccaggtatcttcagaggcccaggtgtggtgtggttggccctaagctgatgggctgactgaaagtctccaggaattcttcctgtctctagattatgcttcattccagcagtccaggaattagactttccctagcctagcacaagacaagtttacttttggtagagtttgaaccagagctgtaccctagacttgaaatggggaggacgggtggaaactatctggacgtggtgggggagacgtatctatgaagtgaaagtttgtatattgaatggtcattccagaattcttaatagcctggcttatactctccagcaaattagaaggttcttctttgggagaaaactggcccagatgctaacaattgagtgttaccctgtattccagttattaccgcctaacaactgttgctgttactattgtctttaaacaacaacaatcgttttattatctcacactttctggtgatgaggatttaggaagacatcagttgggcagctctggcttgggtttctctgacttaagttgtgttcacatggtggctggagctgaacagtagggtgctgaagtggccttggctggccagacagctttcttcctggtgtctcagcatgggctgatttgtgctcctcacaacattatggcctctgactgcttacaagaaagtgcaggcttccaaagcaagtatcgcaagaaaactgactattaactgattcacttttcatgacccagcctcggaagtcacataggctcctttccgatgtagtcacaagtctagtcagcttcaagggcagggaacatagattccatctcttggtaggagtacagaagtggaattgcagtcagagtgtaaggggtccctgtgggatgacatgagaaacattctgtgaccacctttggaaaacacaatctaccacattttctcatttggtcacaataattcacattcctccttcttgtcacttgtgctcacaccctctcccatcacatcgctcccccttcctgctatggcattaacttcaagttcagcatcttgtcacctgaatcaagcccagttgtggccacccaaagctcctcaggtgtggttcctctagagctgaactcatgtgacgtcaagagaaggaatctgttgcttcctctgacttaaaatggcaggacaagcttaggataattgctgtagacacatctgcccagaaaagaggaaacaggaggcacagtagtttctcatccattgccattctgaaattcagcagggcacacgttaccaattccttgatttggtctcagttctggtgcctgggaatgattgtttcaggctctggtttctgctgagaattttgttttgtcttctgagttacccttttccctaagaaatggctgatttttatagctgagtagttttcttagcctttgtgctttcggtagttttggaggaacaaaaaaaccttcccctcattttgtactgtttttgtctctttcagtccaaactggtataattcctttgaaaattttgtgggctctctctgtgtcaatttgtaacctactacattagacaggaaccacacttagcctgtttgtggtaggtccttcatttccttgggctccttgtgtgtcaccagccttagtattcttagaagccctgttgtttgatggagaggatcttaaaatccttagaaggctcttggtctcttggaaaggacagtgcagaaccttcttagatctttttgaggttttaagaaagtattacagtcacagtctgggtttgttctttaccactgagaattttgagaattgtttctttttttaaaattctgcctggaaatatccttaggtagatcatggagtttattaggtgcatttcctgttttccacatttctaaaggccacattttccactacttagacaacaggggacccttttcctgtaatgtacaatagtagttttcatagtttctattaagcttttcctgatagtttccttgttgaggcccttcaggcttttgctgatagcctcttaaaggccttgcaatttccacctgccacccagccccaaagccagtagcacagttctgggtttttgttgcagcatctcacttccaggtgccaaaatctgttccttagtcttgctgcctgaaaaatgacccccaaaagttagtgacttaaaataattccgtgatttctgtaggtcaggaatttaggaagagcttgattgggcaattgtggctcaggttcttgctttggctgcagtcagatggtagagctgaagagtagtgcacaggcaaggcagtgtgcacagctggagagggccgagctgagccgcctccacaaggtctctgtgtgaatttgtttgtgctgcttcttcagggcactcagactgcccacatagctttgtgtccaaatgtatgtcctgtgggaggatgagcagaatctgtattaccttttatgatgacttagtcttggaagttacatcacatcatttctgctctagtcaacaacttgcctggggttctaggggaggaaaacagacctcatatcttagtgtcagttggccacactgtaagaaggtgatatggggtgggagataatgtgatcagctctagaaaaatgtaatccaccatagctcttagtgaaacagttacatccctgtctgatcaccttgcaggggagtcttgccattaataagcaccagctgtgtatgtgacattaaaacttactttttagtacttccttcttaactgtgacttaacagtcaaggattatcaggcacatgaagaaaaagccataacagtctaacacagacagataaaaagaaaccaagtgaagaaataggaaatacaggttgcataagaaaagctcaaatttgaaaaaacaaaaaagcttgaagagctaagagaaaatgcatgacataaaagcaagaaggtataaagtaggggtccattcagagaacaagaaagagctcttggaaaataggattgcaggacaaattttcaataggaaaccaaggaaatcttccagaaagtagtaggcaaagacagacaaaaagagaaagacaatgcctgattggcttcttgactgaaacatatttaggtgggaagaggaagtgtggaaatgtgaataaggactgtatactaatgataatgaattaatattaatttttgcttaagtgtgataatagcactgtggttatagaggagaatgcccttaggcttagaagatgcatactaaaggaactgtcatgatatttgcatttttcagatggttgtgtgcacacacgtgcgctcacacacagtgggagagggagggagaagggagagcggttatgtacaagagagacaactaaagcaattatgatataatattagtaattgatgatgaatacaaaaacaaaacagaagggaatactttagagttaatggattggttcaggagctccaacatctgcactgttagatgttctagagagagaaaagataattgagaggaaacaatattaaatcaacacattaaaaatgttcagaagtgaaaatcacaaatctccacattgagcagacccactgagtgcccagcgcagggaataaaagaaaaaatagattggtacatcacactgagatttcagaacactgagaatagagaagatctcaaaatcctccagtggaagcaagtcaagttacagcagtggactgagaatctgtatgacactagaatctaggtgacagtggagcagtgtcctcagaattctaggagcatacccatctaggatttttttttcttcttttttgagatggagtctcgctctttcgctgggctggaatgcggtggtgtgatctcggctcactgcaccctccgcctcctgggttcaaccagttctcctgcctcagcctcccaagtagctggggttacaggtgtggaccaccatgcttggctaattttttgtatttttagtagagacggggtttccccaccatgctggccaggctggtcttgaactcctgacctcatgatctggccaccccagcctcccaaagtgctgggattacaggcgtgagccactgcacctggcccaatttaggattctatgccaaactgtagtatgaacataaagacatctttatttttatttatttattttatttatttttgagacggagtctccatctgtcgccctggctggggcccagtggcaagatctccactcattgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggcctattatttttaatttgatggtcatattattccagatttggccaatgggatttccttcaagctgactcctgtgtccttttgacaaatatctataatcctttatttatttttatttttttgagacagagtcctgttctgtcacccaagctggaatgtagtggcgtgatctcgcctcactgcaacccccgcctcccgggttcagacaattctcctgcctcagcctttggagtagctgagatcacaggcatgcgccaccacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgaattttaccacaaatgccaccattttgatccaacatcataggattcattttagcccttttcctttccttatttgtagctctcgtctctgacagtgagaatcttggttctcatccttaatatagttactcatttgcttaatctccctgaaagcttggcccagacatggaatccagcaaaggataaggtgaagggaattcttaaagagaaatcttgggataatagctgtgtaggcattcaccagttagtccagattggtgagtgaagacagggctccaaaggggtgttgtcaagaaataaacaaccaatagatagcctgatgtgttgagacttacacatgtagtagaagtttggaggtgaattagtgatacatatacagaaaaccaaacaagcaaaaaaaacaaaaaaaaaatagaattattaattccaggtaaaaaaatcacacataatcacaccactgaactctggcctgggtgacagagtgagaccctgtctcttaacaaacataaattaaaaatcaggtaaaacaaattgtacaagaatggacttacaacaacagaatgcaacaggattcagctatgaatagtatttactagtcataaactacgagagtgccataacactgaacttagggagcaatttagggaataaactgagaaaaaaagtacacaggggccttaggacctaagcagctagtgtgatatcacttgtggatgtttagtatgcattttgggtaccagccccttttgaacactgtctttgaggggaaattgtccactccacagtagaagctattaatatgttttcccatcctctcttgtagtttgtcatagatgtgtgacttctattccatgcaccagggcaagactaggattaggaagcaagtgatgtgaagtagacaagcatggctgccaggtttcagaggcagcgttttctagcggtggtgtccactatgcactgccaagtgtccttgtgtttaacacctgcagcagttaagacctccactgaagcagttctgtggggtaattctggtgttgtcctagttgcatggcttgtaaatctggtttgatgaccttcctgtagagccatttagttgcttatattagctagaatgggctttgtttactgtaaaaaatctggttgacgaaattggcattaggaatgatcctcaagaaaatgaattggttatctaacttggttgtgtatgaaggcagtgaagaaaggtgagagcttaaagaatcatagtggccttgggccgggcgcggtggctcacacctgtaatcccagcactttgggaggccgagatgggcggatcacgaggtcaggagatgagaccatcctggctaacatggtgaaaccccgtctctactaaaaatacaaaaagttagccgggtgaggtggcgggcacctgtagtcccagctactcaggaggctgaggcaggagaatggtgtgaacctgggaggtgcagcttgcagggagccgagatcgcaccactgcactccagcctgggcgacagagcgagactccaccgcaaaaaaaaaaaaaaaaagaatcatagtggccatgggcatggtggctggtgcccataatcctggcactttgggaggctgaggtgggagaatcacttgaggtcaggaattagaggcctgcagtgagtgccactgcacttcagcctgagggacagagcacagagcaagatcctgcttcaataaatggatggatgggtgggtgggtgggtgggtggatggaggaatcatagtgatcagcagtgcttaatgactgagattagtctattctgaagtatgttaataaagcttgaaggatcagaggaagagagtaggaaaaaagcacacacattctacaaacctcgccacatccactcagttaaaagacagaacaggattcccttggatgttgggaaagggaagtcagacgtgaaagttgtagacaggattaagccacttaattttcctattaaatggactctagagagtaagttcatgcttctcattttactgatggagaagcagtaccacatacttggtgaaattcctgtgtctgcaaaacattggttattctgcaattgttatatataaagggataaacattgaagttattggtctcttccttctcattggtattgtgggtgttctttaccaactgagttaggaactgacttgagatattttaaacttacgggacttgatttagagcacttactcttagatgttaaatatttggtttgctctttattgaataacttaattatcttattactaataattcctgtattagacaatgagacttagactcataatagaatacaggtatcttaatgagaatgttctcatttaaaacactaactcctaattcactagcagctaataaaactaacattgttgcacagtacattgttgactagttagaagaatttgacagtatgtttggtgctgagaccagctcggtcggggagaccctaacccagcggcgctagaggaattaaagacacacacacacaaatatagaggtgtgaagtgggaaatcaggggtctcacagccttcagagctgagtattgctattaataaagggtgtagaatttgaaaataggccaggcgtggtggcccacgcctgtaatcccagcactttaggaggccgaggaaggcggatcatgaggtcaggaggttgagatgagcctgaccaacacagtgaaaccccgtctctactaaaaatacaaaaattagctgggcgtggtggcgggtgcctgtaatcccagctgctcaggaggttgaggcaggagaattgcttgaacctggaaggcagaggttgcagtgagccgagattgcgccactgcactctagcctgggcaacagagtgagactccatctcaaaaaaaaaaaagaaaaagaaaaaagaatttgaaaatagcttgagagactagagaagaagtgaactgatttattttatatttatgtatcttattttttggcttgttgaccagaagtgaattgatatgaataagcacacttgcaaaataaatgggttatttatttatttatagagacagggtcttgctttgtttcccaggctagagtacagtggcaccatcatagctcactactgctgctggcaacttctgggctcaacgggtcctcctgtcttgacctcccaaagtgctgggattataggcatgagccgtcatgcctggccccctaattatttagatagccctgtagacctgatttcttgtggctgaaggtctctcaaattgattctcagtaggcttcataaataaaagggaacttacactggaggatctttatgctgaattggcttagaataagtagaaattgctaggaatgttttatttttgtttatttaatttgctaaatctgctttagatatgagccttgtaactggatttcttaaaagtgtccttatgattgaatctatttgtggtgtttggattgattattttaagttcctactatgtaccagacgtttgctacttgttttaacttgctgtttaatctctttgaagaaggaactgtttcctccatttttatagaagagaaaattgaaacttaaagagattagagaactctccttcagtctaggcagagctgggattccatttcaggactgttatgctacaccaaataaatgcttgctgcgttaaagaatgacttaacagtgaacaccttaagtcttcattgcccagttacgtgaatggaagaaaggctgagcagtgaattacaaacactctctcctctagtcttctggcagtgttcctttacctaattctgtgtcctcaaacgccctgttttctttaggtgattatattatttgtttcttttaagcttgcctgtctgcttgttcttctgaacagttcccttcaaatgttacaccatccacccacatctgtatttcagtattttattgtgtcctttcattgagactctaatttgggtgaaaattctccaaactacatttctttttagcatattctatttttgtcacctagaatcagcctcccagctgactttttcccatagatacgtaacaaccacctgctttaacattttctatcttccacttaacaaaaatattactgttgataaataatgaatacttagcatgtataactgtgcaaataaaatgggaggaatgtgtatcgggaagatttgaggggagtgtggataaaaaactgtttgaaaataccagctgttgaattttatagtgttactctttttatttttattttttagttttattattactattttttgagatggagtttcgctttgtcgccaggctggagtgcagtgacgtgatcttggctcactgcaacctctatctcctgggttcaagcgattctcctgcctcagcctcccgagtagctggaactagaggcgcgcgccagccaatttttgtatttttagtagagacagggtttcaccatgttggcaaggatgatctcgatctcttgacctcatgatcttcctgcctcggcctcccaaagtgctgggattacaggcgtgagctactgcacccagcctattattattttttaattgagacttgtcttactttcacccaggctggagtgtagtggtgcaatcttgcctcactggagcctccgcctcctgggctcaatcgatcctcccacctcagcctcctgagtagctgggaccacaggcactcgctaccgtgcccagctaattttttctatttttggtagagacagggttttgccacgttgtccaggctggcctcggcttcccaaagcgttgggattacaggcatgagccaccacgtgcagcctatagtgttattctttagtagttcctaaaaggcttgtgttagatgtttatagctgatagttgtggtttgaatctgtgtccccagccaaatcttgtgtcgaattgtcatccccagtgttggaggtgggggcccatgattggatcatgggggtggatatcccccttggtgctattttcatgatagtgagtgagctctcgggcgatcgggtcgtctaaaagtgtgtagcacctccctcttgtctctcttgctcctcctctggccatgttatatgtgcttgctttccctttgccttccaccatgattataagtttactgaggcctccctagaagctgagcagatgccagcatcatgcttcctgtacagcctgcagaaccttgagccattgaaacctcttctctttataaattacctagtctcatctcaggtatttccttctttctttctttctttctttctttctttctttctttctttctttctttctttctttctttcttttttttttttttttttttgagacggagtctggctctgtcgcccaggccggagtgcagtggtgcgatctccactcactgcaagctctgcctcccgggttcacgccattctcctgcctcagcctcccgagtagctgggactacaggtgcctgccaccacgcctggctaattttttgtatttttagtagagacagggtttcaccgtgttagccaggatggtttcgaactcctgacctcaggtgatctgcccgcctcagcctcccaaagtgtcgggattacaggtctgagccattgcgcccggccaggtatttttttatagcagtgtgagaacagactaatacaatagccatcatgtaaaatacagtttccattttgagccaggcacttgggtaaaaatgaagagtaggtaaaagacaagatgtagttctaatttgagcttgtcatttagtatttgagtaatgccgcataatggctgtgggtttccgatgacacacaccttttcatgatgtgggtggcctagggagtagtgtgtttgttggaaccacagttctctgcagagggaatatgattaagtctgatctttgtaatttagaattaatgaggccaggcgcactagctgacacctgtaataccagcactttgagaggcgaagatggggaggatcacttgagcctgagtttgagaccagcctgggcaagatagtgagaacctgtctctacaagaaaataaagaaaaaaatttttaaaaaaagaaaaaaaatatagaattggtatcttggccacacctctttccctgtggttgagttttttttttttttttttttcctgttcttttcctttttttttgagacaagatctcttcgtcacctaggctggagtgcagtgacatgatcaaggcttgctgcagtgtcagtctcctgggcttaaaggatcctcctgtctcagtctcccaagtagctgggactggaggtaggtgacactagcctggctcactttaaaaacattttttgtagagataaggtcttgccatgttgcccagggtggtctcaaactcctggcctcaagccatcctccctcctcagcctcccaaagtgctggggtctctggcattcaccaccgcggacaacctttttttttttttttttttttttttaagctaaattttgttgaatatttggataggcaatacaggcatatggtacaaaattaaaagatgcaaaagggttatgcacaagagaagtacatttcttaggcattcctggccttccattttcccttcctggaggcagttttctgatttattttctacaaggattctgtttaaatactggagaatatctgacctgttgtactttactttagaatggcaggaagctgaatgactcatgggcatttttccctttgtgaagctcattgacattccttcctctcaataccttaactatggcatgttttataatttgcttttgtttttgctttatcacagtattttcctatgttttttatagtcttaatttttaagcactgctttaggtatctattaatagttcagaaagttgcgaagattacaagctcatatttgtgaaagtgtctggcacataataggtgatcaataaatatttccttctagcttgtctgtcccctatctcccactggttgtatgtatgaaacaaaaaaatgaaggagaaggctgagcatagtggctcatacctgtaatcctagcactttgggaggctgaggcgagcgaattgcctgaggtcaggagttaaagaccagcctggccaacatggtgaaaccccgtctctactaaaaatacaaaaattagccgggtgtggtcacaggcgtctgtaatcccagctactcaggaggctgaggcaagagaattccttgaacctgggaggtggaggttgcggtcagtcgagatcgcgccactgcactccagcctgggcaacagagtgagactttttgtcacacacacacacacacacacacacacacacacacacgtgaaataaacctatgaaccaactaatgcagtggattccaaaattaagattaagcttgtgtaagttgtaatgtttcttgatgtacccatttatttgagtggaaacagattcttttcattctttgaaatcactttgctgagatttttttattttttttattttttttttggagacagagtctcgctgtgtcgcccagactggagtgcagtggtgtgatctaggctcactgcaacctccacctcccgggttcaagcgattctcctgcctcagcctcctgagtagctaggattataggcatgtgccaccacactcagctaatttttgtatttcagtagaggtagggtttcaccatgtaggccaggctggtctcaaactcctgacctcaagcgatccgcctgctcagcctccctgagtattgggattataggtgtgagccacggtgtcccgccaagctgagacatttttaagaaaatgtttctgtttttttgtttatttgtttgttttgagatggagtctcactctgtcacccaggctggagtgcagtggtgccatcactgcaacctctgcctcctgggttcaagcaattctcctgttccagcctcctaggtaactgggactgcaggcttgccaccatatacctggctgattttttgtatttttagtagagatggggttttaccatgttggccaggctggtcttgaacttctgactcaagcgatctacccacctcagcctcccaaagtgctgggattactcccacagcacctgctcagaaaaggtttcttttcttttctttttttttttgagatcaggtctcactctgtcgcccagggtgtagtgcagtcgcgcaatctcagctcactgcaacctccgccttccaggttcaggtgattctcttgcctcagcctcccaagcaggtgggatttcaggcatacaccaccatgcatggctcatttttgtatttttagtagagaggggtttcaccatgttggccaggatggtcgcgaactcctgacctcatgtgatccacccgcatcagcctcccaaagtgctgggattataagcgtgaatcactgcacctggctagaaacatcttctaaagcctaatcttttttttttttccttatataatttaggttgactatgtaaacccaaaacacatagggtagaaactcgtgaaaaatatttttgaggatatctttgcaaagtgttgtgcctcacggtgctggatatggatgtgtgcttagtgtcagtgcatagatttaggatttcccacctgtatgtatgcttttggtgagtccttttaggcgatatgtcctcatgttcaaggagtaatggcatactggttcatttaaacccatgttttaatcctaatttaagaccgatttacttcttcttggagctaatttcttaacttttctgatgatgtttttgttgcttaagttaagactaatataacacagaagtcttactcatcctttttgatattagagattttggtttattaatctagtggaattttaaatatcattttacatgtttactctcaagatctgatgattgactgactgggtgcagtggatcacacctgtaatctcagcactttgggaggccaaggcgggcagatcacttgaggtcaggagttcgagaccagcctggctaacatggtgaaaccctgtctgtagtaaaaatacaaaaattagccggacttggtggtgcgtgcctgtaatcccagctactggggagacagaggtgagagaatcacttgaaccccagaggcggaggttgcagtgagcctagatcactccattgcactccagcctgggcgacagagtgagactccgtctcaaaaaaaaaaaaaaaaaaaaagaagattgaattaagggcaaacttggaacaggccagtttcccattatattgcctctctgaaacaagtgaaagagttttctttatgaggggtgttctttttaatttaatttaattaatttttatttatttattttgagacagagtcttgctctgttgcccaggctggagtgcagtggcatgatctcggctcactgtaacctctgcctcccaggttcaggtgattctcctgcctcagcctcccaagtaattgggattacagatgcccaccgccacacccagctaatttttgtatttttagtggagacggggtttcaccatattggtgaggctggtcttgacctctgaacctcagatgatctacccacctcggcttcccaaagtgttggggttacaggtgtgagccactgtgctgggccttctttttaaaaaaggtttttctggccaggtgcggtggctttaatccatatgtgtgagaccaggcacggtggctcatgcctgtaatcccagcactttgggaggcagatcacctgaggcatgagaagtgcttgaactagggaggtaagaagttgcagtgagccaagatcacaccattgcactccaggctgggtgagagtgagactctgaaaaaaataataataaaaatggttttcttacttttatgacttgaattatggaaagtttttagaatgtgactcttttctcaggaacaggatggctacctacctaccccccatccttttcctgtatgctatggattatcagacccctcacttgggttcctcttacatcaccaaggtgtgcttgtcaatacccagaaaccaacactgatacattactaagttccacattttatttagattccaatagttttcccattaatgtccatttctgttctagaatccaatccaggttactgtatgcattgcatttaattatgatgtctccccagtttgctgtttttcacatgactagactagggttatgaatttggggaattcatatgattggagtggtgggaggtgtagtgcatgctactccatgatttattgctggtaatgttaatcgtggccaaggttgtttccctactgtatacactcaccaccttccatacttatttttttggaaacaagttagtaagtccaacctacactcaagtcggggagatttaagctccatctcctagaggggagtggggaatatttacataaattatttgaaattctcccacgaggaagctgctttttctaggaaaggtctttgcccgttattctaccgacttactggactttttatttgactttttaaaaagaagctctttagataaaatctccataaatacttagataaattactgcaattttatatttgcatatgaacaagtggagttttgttgatgcagggttgcattggccttcactatcaaaacaaatgtctcatctgatcagcatttataaatagtgaggtaccagaatcattaaggctcataaagtcttccgtttttattttggctattctggtggtgggtaacaatattaacaacaataaaaattcatcttattttactggagattcctgcaaagtggcagaataccaggacaaggaaccaattctggcacacatgtgtcaaacaagaaagctctgggaatgtaataatgtaataaagtgtggtcgagagagctctgggctggaataggcatggggtccttgacactatcacctctgccaagacacttcatgtgtatggtttccccacctttaagtaaactctatttatgaagttctttgtagctttaatagtttctagagttgcttgaatttggggtgacttcttgcaagggtaatgtgaagtagtgtcacatggacagtaacggagaggtatctgctgctgccatttatataataaatctgaatttggaggcagagaaaggaggcagaaagtttggtaaggacgttattgcaacctgaataagccacttagggcctagatcagtgtttgggaatgtgggagaagacagccatagtcaagaagcgtgaagtagttaatgttgagttatttttaggtggtttttctgttctttttactccagacactgactttcgtaataagataaataatctggtgagtcgcatgctcatggtgtgctgaggcatttagccaagcagcttatgcatgtattatctcatttaattctgtcactatgaggtagagattatctttaaccattggttccaaatgagaaagccctgtttgaaataatttttccagtgtatttaaattttgtaggtacacacctagaatttcaaactgatggtctgagttctgagcccatctgtttaattcatcctaatgggttatcttgtggatatgctgattatagtaaaacaactttaagaatgtgatatacattatgagtgatacttgtggtttgaatgggtttttttaaacaacatgaaaatttgaagatattttgcatagatttgcttttgggtaaaacttttttttttttcatatcttctgtaattaacttctttccccccttttttgagatggggtctcattctgtcacccaggctggagtgcagcttgatgtatgatcatggcttactgcagccttggactcctgggctccagcaatcctcccaccttagcctcccaagtagctggaagtacaggagtgcaacaccatgccctgtagagacggagtcttgctgtgtttcctaggctgatctctaactcctggcttcaagtggttctccctacttggcctcccacagtttgattagagatgtgaaccactgtgcccagccaaaattaactttttaatctattctaaatcaagaagaaaatagatgtgtcttttctgggactagtaatgagaaattgacagcatctggtttttggctgttgttaaagtgtgattattactatactggtatgctgataaagagattgcatggtaattttcatcctttcatctaaaaacataatattataaggatagatatttccttagtatggggtgacttgtgtagattactatctcataaattggttcagattagtttttaaaaagggcaaaattgtatattagtgatattgctcagctctttttcaaagggataaagcactgtaaagagagaatgtgggggtagaagtctaataaaatcctcacaaatctggatcagtaacagaaaagtcagttataggccaggtgccatggctcatgcttgtaatcccagcactgtgggaagctgaggcaggtggattgcttgagcccaggaattcgagaccagcctgggcagcatggtgaaaccctgtctgtactaaaaatacaaaaaattagctgggcgtgatggtgggtacctgtagtcctagctacttgggagtccaaggtgggaggattgcctcaacccaggaggcgcaggttgcagtgagtcgagattgtgccgctgcactccagcctgggcaacagggtgagaacttgtctcaaaaaagaaagaaagaaaagtcacttataattatgtgggctttaaaaaacctgactgatagtgctctgtttttagtttcaccaaaagataggtagtacttccatcctctttcatgaaactacagtatgtctattctcaatgtttcaaaaccttgtaagactcagagggaagaaatagtttctcattaagaaaaatttagtcaacagtataattatgtattaagtgcttcaggaaaagcaatgggggaaagtatttcctacagtattaggtctctcattagaggtgagcagagggagttccttcagcgcaggacgggcatttctgcaggtgaagtgggatgagacaaccggctatagcaagatgttagcatatgtagttagcttatggaaacataatttgaattggacatgagtttttgtttgtttttgaggcagagtcttgctctgttgcccaggctctattgcaatggcacgatcatggctcactgcagccttgaactcttggactcaaggagttcacccacctcagcaacccaagtagctggaactacaggtgtgagccacaatgccttgctaatttttttttttattttttgtagtgacagggtctcactttgttgcccaggctggtctcaaattcctgacctcaagcaatcctccagccttggcctctcaaagtgctgggattataggcgtgagcactgtgccctgcctatgagttgttatagactgggtgattttgtagtaggcagcagtttgttgtcatttgcatgttgtacttcatgtatggttttcccaagtcattaaatgtacatacttctgcaactttttattttttattttttctggtgaaaagatatacatatatttagaattagccagctggactcagtttagatgaccccaattttgttggcaacatccaaagcatcataatcaggagctagttgaacgtatgcctccttctctccatcaggccgaatcagggtgttgaccgggccacatcaatgtcatagagcttcttcacagcctgtttgatctggtgcctgttggctttaacatctacaatgaacacaagtgtcttgttgtcctcgctcttcttcatggcagactcagtggtcagcggcaacttgatgataatatggtggtcaagcttgtttctcctgggggcgctcttctgaggatatttgggctgcccctggagtcgcagtgttttgggccgctggaaggtgggtgatgtgtggatcttttttttttccggctgtggacgcctttcaacactgctttcttggccttcacagcctttgctttggcttcggcttgaggaggggcaggagcttccttctttgctttcggtgccatcttgtgaaaagggctctgcagcttttaatgtgtacagtttccatgatatgattgtaccagattataagattatgttggacatttgagttctttccaatttattgctgttttcagcagcacttgatgaataactttgtagataagtttttgcaaagctttatgaatattttcttttgggataaattgctagaggctcgggtaaacattgccaaactacccttcagaaagcctgaacttatttacagtacacttatggtatggtttggctctgtgtccccacgcaaatctcatcttgtagctcctataactcccacatattgtaggagggacctggtggtagataattgaatcatgaggccagatctttcctgtgcttttctcttgctagcaaatgagtctcatgagatatctaatagttttaaaaaggggattttccctgcacaagtgctcctctctgcctgctgccatccacgtaagactgagttgctcctccttgccgtccgccatgactgtgaggcttccccagctgcatggaactgttaaatccagttaaacctctttgttttgtaaattgcccagtctctggtatgtctttatcagcattgtgaaaacagactaatgcaacttctctcaacatttctagtggacaggttttctatgttcccttctaacatcctgttttgccaaacttttgcaaagaatttcatattgtcttttttcctaattcaaccttttgtaaggaactcttacaacattggtgtaaaggtatgtccttagctggtggtacagtagttagaagttttctctgggttatggtgatattgggagtaattgtgttataggataatctgggctctctgtatttcataagattgtggtgcctcaccatcagtcagactgtagcttcagggcttttttttctcttggattgcttggtggtgaaatatcaatacagccttgcccattctgattagtgtgttacattactgatagggcagtgttaagagaaataggagaaacctgagcctaaaacatttcactgtgaaattaattggtctctgaagtgttttgtctttgtttaggtttgacgatcgtatgtggcgaaattacattggtggtaaatgataagcttgttatattgataacatggaagaaaagtgtttctggtttctcttagagaaaatcgattcccagtccaaggcacctgtgagtccaagagaatgagagaaggtaagatgttattagttagaaactgactatacaattccagtttctagtgcagagttgacttcagtagcatttgattagcatctaacttccttcttgggggaatcagaaaagggacatagattaggcattagctgaactcagattactggaaagtgattgagtcagttctattttttatttttattttttgagacagtctcactccgtcacccgctggagtgcagtggtgcagtcttggctcatgtcaacctccgcctcctgggttcaagtgattctcatccctcagcctctctagtagctggaattgcaggtgtgagccaccacgcccagctgggtttggttttttttgcatttttagtagagccaggttttcaccatgttgtccaggctgttcttgaaatcttgacctcaaatcgtctacccgcctgagcctcccaaagtgctgggattacaggtatgagccaccatgcctggctttgagccagttctaagggaaattattcatttatttttgtcagcttgtaatattgcaaatcatagtatttttgaaataaccttcccatgggaatagagtttatgcccttaaagggtagagtgctattataaagagagatacaagaagagagggagtgggtggcattccagagatcaggtctacatgagttgctgcccagccttcttggttctcaaacttgtcggtctggattgctgtgtttaaggaaagggaatagaacaatatactccctttctaaaatttttcattaattggctacctaacctatgttatgcatattaatttacttaacatttatgaagtacttataatatgctagacactgaagatactatggtctgaaagatggcaaataatagaggagaaagaaaatcataattgctattatttatgaagtattaagtacaggcagttcttaagcattcgacttagtatttttcaactttaagatggtacaaaagtgatacacactcagtagaaactgtattttgaattttgatcttttcctcggctagcaatatgtggtgtaatacccttacatgagatattcaaccctttttttttgttgttttttggagacagagttttgctcttgttgcccgggctggaatgcagtggcgcaatctcactgcaacctctgcctcccgggttcaagcgattcttctgcctcagcctcccgagtagctgggattacaggcatgcaccaccatgcctgactaattctgtgtttttagtagagatagagtttctccatgttggtcaggctggtctcaaactcctgacctctggtgatccacccacctcagcctcccaaagtactgggattataggtatgagccaccacacctggcctcaacactttttttttttttttttttaaataaaataggctttgttagatggccttgcccaactacaggctaatgtaagtgttctgagcatgtttaaggtaggctaggctatgatgcccattaggttaggtgtattaagtgcatttttggattacaatattttcaatttgtgatacatttatcaggactaacactgttgtaagctgaggagcatctgtatgtaccaggtacttaatattaaggtggcctttctaattctcatagaaacccatgcaaggtaggcattatcctctccatttttctttagggttagtgaagctaagtagcttgttcgtcatcactcaataacaaagtggttaaaatgggatacaagtccaccatgggattgagtcccagatgggagttcagatgctgaccagtgttaggatctaagtgcaagtcacttaactcctcttttcaaatgtggactacaacagttcttatctcatagggcttttttggtgtgtgttatgtgacagataggtgaagtggttagcccagttactggcacgtagtaatagttaataattatattagatcatactggctcaaaagccattaatagtagttactgctggtagttgagtcttacaaagccattgttttctccacatgtctttatgcaaatcattaatgacaagagcctaaactgtgatagagaaggtgtccccagtgttatgagagtattgaagaggaatggactgctaacctggactaggagagtaagcagacttacaaagatggtgatccttgaggggtcttgaagcattattaggagttagctggtgggaaaagataaagagaaggaagtgggttagaggaaagtcatggcaaagcaaaaaggcccagaaatgtaatgactgtgtgagggatagagtcctgagggtgagacataggttagaaagataagcaggccagattatgaagggtcttgcatgccatgggttttttccctaaagacagcgggggaagcagcagaaggactttttattttggaataattttagatttacaggaaagttgtaaagatagtacaaagagtttccatataccctacacccagtttccccgttattaacatcttacattagtatggtacatttgttacaattagtgattgattgatttgtaattattacctgaagttcataatttattcttatgttcttagtttttacctaataccccttttctgttccagaatcccatcgaagataccacattacatttagttgccttgttgctttaggttcctcttggctgtgacagtttctcaagatttttcttgtttttgatgatgttttagttttaagaagtactaatcagaaattttgcaggatgtttctcaattgggatttgtctggcatttttctcattattgtactaaggttatgagtttggggtaggaagaccacagacgtagagtgccatttcatcccatccaagggtacataccatcaacatgactgatgactgctcatgttgaccagtgttgcctggcggagtactttacagtggaaacgtctgagtttgtcagaagtttcagctgtaaagtactcttccatctcctgctccgcccctttccatacaacccccttttttggaaagaggtcactatgcacagcccacactgaaggggaagggagttatgatccatatctcaggaaggacttttaacgtggaaagtgatttgatcagaattatgttccagggccaggcacggtggctcatgcccataattccagcactttgggaggggaggcaggaggatcagttgagcccaggagtttgaggctgcggtgagctatggtcatatcactgcactccatcctggacaaacagggcaagaccttgtttcttaaaaaaataaagaatgggctgggcgtagtggctcacacctgtaatcccagcactttgggaggccaaggcaggtggatcaagtgaggtcaggagttcgagaccagcctggccaacatggtgaaaccccatctctactaaaaatatgaaaactagccgggcgtggtggtgggtgcctgtaatcccagctgctcgggaggctgaaggaggagaattgcttgaacccaggagatggaggttgcagtgagctgacatggtaccactgtgctccagccttggcaacagagtgagactctgtctcaataataataataataatgataataataaaaaataatgaattgtgcttcagaaagattgctctagctagtggagaaactgaatctggggagaccgaatttagcctgcaacctttaagacaggacaagatgagaaaccatgaagttggaaactgaaggtcagtggcagcagggttggagagcgatggatttgagaaaagtcgaagagattagtggatggggctcagtgggttttgcagagtgtgtgtgctcgagtgctagtagcagatgaggggactccaagatgacttgccagccatattgctgggagttggtgactatacaagtgatagtgttaatttttttaggtaaacaagaagaaacagcttgttgttgatagtgggaagggtgaatgagagggcaataagctgtgtcaagatgctttttgagttgttcttggcttatatgcgtattctgtcttgagataaagatttagaagtcattaccataataaatgtggtttgagaaatttgcagtgttagatgttatggcataggaagagtaattaataccagatgaaaaagaggaacccagggaacactgatgtttaaaaaagtggtagagaaaacgtggggaaaggtcaacttttgttaaaatctcttattcatgtggctgtttaattcctctacatcacatcctctcttctgttcaccctggaggtgtaaaacactataccaaaggacagaacacactatacacgtttagaacatttcttctgaggatagttactgctgcggtaatgcaggtactgttgtggtgatgctaatgagaataaatcttgctaaaattaagaatcaagacagctgaagacctatggaaagcaattgaccgaacagtactacttcaggtcaggtaagcagtggcagtacaagaatgaagaatggattctttgttaccaagcaattaacaatctagttgggtatttactgggtaatacaatacaaagtaagcaatggtaattggttatgtgtatgtcagttgtggcatgatagtttctacctcggctatctgctgaagccctttctgtctgtcttctctccctgtccagctttgttcttgcctgcctttttattttttacagtccctctccttttttgcaggggggcggggcggtgctagtgggagtatacatacccctcgttaaccacctgtgatgtaagttaagatttttttttaaatgtttctgttttttaaaaacaagtgaatagagcatttattatcatggaggataaaatcctcaaagaaaaaatctgtttagcttttaaattcttcgtgaaatcgctaatctttgaggcgaaaaattttttcccgtaaatttaggagaacatgagatttgagtttttaaggactttatagcgtgcctatgtttattgtagattttaattccagagagctggtgattggaaatcatggacctatttgttccaatttaaactttcagcatttaaaaaggaagagataagagagaaccagacaggaggtatatagtttgtagaaagatacagatatttaatgtaatcccagcactttgagaggctgaagcgggcagatcacctgaagtcgggagtttgagaccagcctgaccaacatggagaaaccctgtctctactaaaaatacaaaattagccaggcgtggtggcacattcctgtaatcctatctacttgggatgctgaggcaggagaatcgcttgaacccaggaggcggaggttgcagtgagctgagatcgcgccactgcactccagcctaggcaacaagagtgaaactcggtctgaaaaaaaaaaaaaagagaaaagaaaagatacaggtattgaaataccaaagttgcttctgacttcctcattttatagagagtgaactgttgtcagttgagaattcttaagccatttaacttaaatgctaaaatacttaatgtggatatcatggggaggaaaaatgttctttacattctttggtttttgatcataatgtatggtgtctttaaaatctaggcattgtagcataatggttaacaccaccgactctgtcttctgctgttttcatacctcttccttaagcttcgactcagcttcactgctcataggtgtgatgttgggcagcttacttcatctctctgtgctttaattttctcatctataaaatggatagtcgtaagattgaaatgaactaaggcacgtcaaagtacacagtgcctagcacatagtaagcatttataactgttacagcaatagtaatcatatatactcttgccattccctttgatttctatctttttgattacccaacgtcagaagccaaaaattttggagtcataaaacgttttttggtccctaacataattaagttaaatttactcatgcgtagcatctcaggatatattgaaagtatgggtggccagtccatacatttaagaataagaattataagaatttagagacagagccttgctttgtaccccaggctggagtgcagtggtgtgacctcagctcactgcaacctctgcctcctgggttcaagcaattctccggcctcagcctcctgagtagctgggattacaggtgtgtgccaccatgcccgactaatttttatatttttagtagagacggggtttcaccatgttggacaggctggtctcaaactcttgacagcaagtgatctgcctgccttggcctctcccaaagtgctggggttacaggcatgagccacttcacccggccagaatttacctttttaaaaagctttatttattatctttttgagtcctactgatgagtaatttggagtttcatgtgtcctttttatataggtattagagtatgacaatgacatctataatgggatagaatttaaattttaaagcaaaccaaacagctgtcctatttatgagtgctaacttaaagatggtttgataacatgaaggtaacggtactatgaatgtgaatgtaatgaccctatatatacacaataaatatacacaatatatatacagttctctgtttatacttttcagcttcagttttcttgttctgaatttaagcaagaaggtagcatttaattcatagcttattgtgctactcctgttttcatacctcttccttaagcttctggtaaaattaaaacatttcaagtagagtttaggattgtagaaaacaaggcatgttgttaaaacctgtaattgtgagcgtgtcttaaaatgacaagattattatatatatatatatatttatttattttacttatttattgattgattttgagatggagtcttgctcttgtcgcccaggctggagtgcagcggtgttgtctcagttcactgcaacctctgcctcccgggttcaagcaattctagtgcctcagcctcccaagtagctgggattacaggcacctgccaccatgcctggctaatttttgtatttttagtagagatggggtttcaccatgttggccaggctggtcttgaactcctgacctcaggtgatccacccatcttggcctcccaaagtgctgggattgcaggtgtgagccaccgcacccagccctatcttataattattgatagcaagaaaagcatattcaccatttgtttcagttctcattgttttcgcttccccttctgtgtttatccatttggccattctctttcttgtgttcatctttctgttctgactcaggtcattgaggatatggttggaccctgaatggtagaaacacaactccctcttcccctcgactccacagacttaatgtgattttttagggtataggggagggggttatgagaatgtgggaacccaagcaggtgttctaatggctgtggagtaacctgtcttctccttccagttagtttctgtgttttgtttgtttgtttgttttaaagagacagggtctctccctctgtcgcccaggctggagtgcagcagggtgatcatagctcactacagccttgaactcttgggctcaagcaatcctttagcctcaccctctgaagtagctgggactacaggtgcttaccaccatatctggctaacttttaaaaactttcagagatagggtctcactgtgttgcccaggctggccttgaacttctggcctcagctgatcctcccacctcagcctcctgagtagccttgctttttaaataacagctttactacaataaaattaacaaaacacgcagttcacttatttaaaatatgcaaaattcagtggttttcggtatattcagagttgtgtaactatcaccacaaatcaaatttaaaacattttatcatcccatgaagaaatgctgtacctgttagcagtggcaccctgttatttcaaatgccctacagcctctggcaatcactaatcatctttctgtctggacggttcatgtaaataaaatcatacaataggctgtggatttttgtgcatgtgactggctgctttcacttagcatagtgtttcaagtttcatactgagcatgtgttagtgttttattttcatggcagtataaagttctgtcatatagacatactgcatttttttattcaatcggttgatgggcatttgggttgtttctaccttttagctgttgagtaatgctgctatgaaaatttatatacaaattattatgtggatatatgtttttatttctttgggctgtatacctaggagtggattttctgggttatatgataattttttttcttttttgagatggagtctcgctctgttgcccagtctggagtgcagtggtgcgatctcggctcactgcaagctccacctcctgttacgccattttcctgccttagcctcccgagtagctgggactacaggcgcccgccaccacacccagctaatttttttttgtatttttagtagagacggggtttcaccatgttagccaggatggtctccatctcctgacctcatgatccgcccgcctcggcttcccaaagtgctgggattacaggtgtgagccaccacgcccggcctctgggttatatgataatcttttgaggaatggcaccattttatattcccaacattttagccaaataatctgactaaaaacaggcaaaagagctgaatagacatttctccagggaagatactcagatggccaataaacttatccaatatgctcaacctctttattcagggaaatgcaaatcaaaaccacagtgagagactacttcacacctgctggctagaatcaaaaagtcagataataacaagtgttggtgaggatgtgtagaaattggaactctcataccctgctggtgggaatgtaaatgtaaattgctgttctgctcccaaacagttgacaagtaaaatatagcattatagagtgagaaataactcagagtttcagagtagaactgaaaatatactagaagagtattttccttagtgttggactagatgattttaaatttgaacacagacattgtatcaggtaacatcaaatcatacagtgaagggtttctcacaatgtacacaaaatagtatttgtctgcttaacactgggatttgcaaagaacagtgaaatattacagtgttacaaagcaagatcttcctctctttaaatgcctgttaacctgattttaagaatatctttattgtatacatcttattctttaaatgtaccccataactaatagtaccaattttatgttttcaacatttaagttatgatattatacatttcctttaacttgctttttctattcaaactggttgatagctgtagatctgattttgttttctatatttaattcccttgaagtcacataccacggtttatccaatccctgattttttttttttttttttttaagacagagtctccctctgtggcccaggctggagtgcactggcaggatctcggctcactgcaagctccgtctcctgggttcacgtcattctcctgcctcagcctcctgagtagctgggactacagtcgcccactaccatgcccggctaatttttgtatttttagtagagacggggtttcactgtgttagccaggatggtctcgatctcctgaccttgtgatccgcccgccttggcctcccaaagtgctgggattacaggcgtgagccatggctcacgtgagacagagtttcactctttttgcccaggctagagtgcaatggcacgatctcggctcaccgcaacctccgcctcccgggttcaagtgattctcctgcctcagcctcccaagtagctgggattacaggcatgtgccaccatgcctggctaatgttgtgtttttagtagagacagggtttctccatgttgctcaggctggtctcgaactcccgacttcaggtgatccgcccgccgccgcctcgccaagtgctgggattacaggggtgagccaccgcgcccagcccccgttgatgtattttaaagattttcctctatttttgtcctatagacgattctgtagtaactatctatgttattatgtagatagggttcttcagataaacagaactactagaatatgtatgggtgtatctatgtgtacatatattcagagatttattttaaggaattggtttatgtagttgtaggggcctgacgagtctgaaatctgtgcaggcctataagaaggagttagggccttagtctcaacttctggaaaaatctcaatttctgctcttatgacctttaggtgaactggataaggcccacccacattatggagggtaatcaagagattatagatgttaaccatatctactaaatacttttcacagtaacacctagattaatgtttgattaaataactggctactagagtctagccaagttgacacagaaaactaagcaacacactgtccttccatgtgcaccagagactttcagactttaaaaaacctccaccaatagtttatacacatacttaatgaaaccatatgctgatgttttctgttcttattcttttttttaaaatgctgattaggaacccaaaattcaatgtgagtagatctgaccagcaatttgaaaaacattgcatatatatgtagtctagaaatggaattgctggcttgcaaggtatccacacgtccactttactatacattgccagtttttttctctgaagtagttgaaccactgtacagccctactagccgtgtgaataaaccttctttcttacccccttgatggcaactggtaattgcagtttccttgtagacctaattattccagataggtctgggcttattttttaaggtctttaaaacttgataaaaatcgactttaggccgggcacggtggctcatgcctgtaatcccagcactttgggaggccgaggcgggcggatcatgagaccatcctggctaacacggtgaaaccctgtctctactaaaaatacaaaaaattagcagggcgtggtggcaggcgcctgtagtcccagctacaggctggggcaggagaatgacatgaacccgggaggcggagcttgcagtgagccaagatctgcactctagcctgggcgacagagcaagactccacctcaaaaaaaaaaaaaaaaaaaaaaaagtcaactttaaacaaagagacctgcctgtgttggcaccttcagcaaatattagtatctacccagaaattaatgacatttctttattttcattgtatttatattttttgatttacatatagcaaaactgaataatttttggtgcacatttttgtgagtgttaagacatgtatacaatactcctcccttatccatgaaaggtatgtttcaagacctctggtggatgcctgaaactgtgggtagtactgaaccctatatatatactatggttcttcctatgcatacatacctatgataaagattaatttataagttagacacactgagagatcaacaacaaaaaataataaaatgaacaattataacaatatgccaacatcgccaatactttggggctgttagtaagtaaaatacaggggacttgaacacaaatgctgcgatgctatgacagtccagctgataactaagatgacccaagtgactaatgggcacatagcacctacagaggggatgtggtgcacaaatggatgattcaggtactattcctggaattttcatttgaatgttttcagaccacagttgatcatgggtaactgaaatcacagaaagcaaattccaatgcggggcaccactggagtttcatataccaccaccacaattaggataccaaagagttccagctcctccaaaagctacctcagactttcttaagcttcctcacacttctagaccctggaaaccttggatctattcattatccctgtacttttgcctttttcagagtgtcgtatgaatgaacttgtactggcttctttcactcactgtaatgctttggaagtaggtctaggttgttgaatatattagtagttcactatttttgttgctgtgtactgttccagtatatggatgtactacagttggtttatccatttacgcattgaaaacatctgaatatttcacagtttttttttttttttttccccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcgcttcccagtaggggcggccgggcagaagcgcccctcacctcccggatggggcggctggccgggcggggggctgacccccccaccaccctcccggacggggcggctggccgggcagaggggctcctcacttcccagtaggggcggccaggcagaggcgcccctcacctcccggacggggcggccggccgggcggggggctgacccccccacctccctcccggacagggcggctggccgacccccccccacctccctcccggacggggcggctggccgggcagaggggctcctcacttcccagtaggggcggccgggcagaggcgcccctcacctcccggacggggcggctggccaggtggggggctgatccccccacctccctcccggacggggcggctggctgggcggggggctgaccccccacctccctcccggactgggcggctggccgggcggggggctgaccccccccacctccctcccggacggggcggctggccgggcagaggggtcctcacttcccagtaggggcggccgggcagaggcgcccctcacctcccggacggggcggctggccgggcgaggggctgaccccccacctccctcctggacggggcggctggccgggcggggggctgacccccccacctccctcccggacggggcggctggccgggcagaggggctcctcacttcccagtaggggcggccgggcagaggcgcccctcacctcccggacggggcggccggccgggcggggggctgaccccccacctccctcccggacggggcggctggccgggcagaggggctcctcacttcccagtaggggcggccgggccgaggagcccctcacctcccggacggggcggctggccgggcggggggctgacccccccccacctccctcccggacggggcggctggccgggcagggggctgaccccccctcccccctcccggacggggtggctggccgggcagaggggctcctcacttcccagtcggggcggccgggcaaaggagcccctcacctcccggacggggcggctggccgggcagggggctgaccccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagagaggctcctcatatcccagacgatggggggccaggcagagacgctcctcacttcccagacggggtggcggctgggcagaggctgcaatctcggcactttggggggccaaggcaggcggctgggaggtggaggttgtagcgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggaaggagaccgtggagagagagggagacgagagggagagggagagggagagctgtttcacagtttttgatgattgtgaataacgctgcctatgtgtgcaggtgcttttttttgtttgtttgttttgaggtggtgtctcgctctgtcgcccaggctggagtgcagtggcgcgatcttggctcactgcaagctccgcctcctgggttcaagccattctcctgcctcagcctcctgagtagctgggtctgcaggcacacaccaccacacctggctaatttttgtatttttgtggagatggggtttcacagtattggtcaggctggtctcgaacccctgacctcaggtgatcctgagcctcccaaagtgctgggattacaggcgtgagtcactgctcccagcctgtgtgcaggttttattgtgaacatatgctaattctgtagggtatatggctgaacagtggggttgctagatcagtcatttggtaaatataattatgtctttgtaaaaaactgcaaaactttcccagaatggctttataattttgcatttacaccagcagtgtatgagaatttcagttgttcccattcttgtcagcactttgtagtgttgatgccttttattttagacagcctaacaggtaaataatggtttctcatcatggctttaatttacattttcctaatggctaatgatgtagagcatcttttcatctaatataccccctttatatctactttggcgaagtgactgttcaaatcttttggccattttaaaaaaattgtgttattttccttattgttgactttgaaagttctttatgtattctggatagaagtcctttgttgcatatgcgatatgcaaatattttcttacagtccgtagtgtatctcaacagtgccttttgcagagcaaaagtttttaaattttatttttagtataccattaaaaaatgtttggtggattgtgattttggtactgtatctaagatctcctttcccaatccaaggtcaaaaagatttccatgtgtttttctttagaaattctataatttttcagttttacacttagttctgtcatctgttttgagataattttgaggtatggatccaaatttttttaaaaaaatgtttgttttgtttttgcatgtgaatattcatttgttcctgcatcatttgttgaaaagattattatttttggcttgattttgccttcgtgcctttatggaaaatcatttgatcctgtatgtgtggttctgtttttggactctattccatttatttccctttttttttcttttttttttttgagacagaatctcgctctgtcacccaggctggagtgcagtggtgcaatcttggctcactgcaagctccgcctctcgcgttcacgccattctcctgcctcagtctcccgagtagctgggactacaggcgcccgccaccacgcccggctaattttttgtatttttagtatagacggggtttcatcatgttagccaggatggtcttgatcccctgacttcatgatcctcctgcctcggcctcccaaagtgctgggattacaggcgtgagccactgcacctggccttttctctgtctttatgccaataccatacattcttgattactgattttttgtaattagtcttgatttagatagtgtaagtcttccaactttgctctttttcaaaattgcattggctgtctcatttactttgcctttctttatgaattgtagaatatttatcaattacggcaaaagaaggtgctacaattttgattggagttgcattgaatctttagagcagtttgggaagaatgccttcttaataataagtctatatctatgatctatttcttcatcttcttagatcatctttagtttctctcagcagtgttttgtagttttcagtgtacacatcttactttatccctaagttatttcatatttgatgctaatgatctttaattttgatttttgattttttttttattgctggtatatagaaatagaattgactatttactattaatattatttcctacaaccttactaaacttgtttattctggtaccattttgtagattctacaaaatgtagattttctacacagataatcgtgcagttttgattgtacctttccactgtggatgcctttatttttgttttactttagacttttattggaaatacagcaggacttatttgtctttgtattccctttggggtccctccccacacatacctttgatgacttttgttttagattctttgtagcgttagcattgttctgaagtcagaactatgtatatatctataaaaaaggtatacttgggctgggcgtggtggctcacacctgtaatcccagcactttgggaggccaaggcaggcagatcatgaggtcaggagttcgagaccagcctggccaatatgatgaaaccccgtctctactaaaaataaaaaattagctgggtgtggtggtgcacacctgtagtcccagctactcaagaggctgaggcaggagaattgcttgagcctgggaggcagaggttgcagggagccaagatcacaccactgcactccagcctgcgtgactgagtgagactgtctcaaaaaagaaggtaaactcaaaggcggtcactccatcttttttgtcatatttctttctcatctacatcctcttcccatctgcaacagaaattcaacttttaattttacctaattcatacttttcacactttgggtccttttcactattctgttacggttctttaaagtaactgcctctcagattttactaaaaatgtaaaatttcctctttatgaaacctagaacacattggtagacaaaattaaagatgggagatctggtggtatcataaaagaagaaattcgtcaaccagactgtgggtttcctagatttttgtttatagtaggttgtatgttatatttagttgcatttttccccctagagtttaggttccataactttcatcatattttcagagtaatttatttaaaggaaaaaaagtggccaaaattaacctttagaatgaataagtctgggcctaaccagtgtgaaggtatggtcactgaacctcctgtttctcgagtctttgccttctgaagatatgtgtattgtaatagatgacagccgcttgcggttaattcagtaatacatgtcagctccacccctggcacttttaaaccttttggcctactattttgcaaaacagatttttaagaattagtatgcattttagaagtttcctttcaggttaaactttttaaatagttattctttaataatgctgttaaaagaattttgggatttctattgccaagtcactaaaaagtaactcaggcagagaagggtaagggtgctgcaagcacacatgaagaattaacattttaaaagaacctttgagcaccttggcacctgtggatttcttcttggatgtctcatgcctaaaagcagagcagcatactgtaaaatcagtaaaagtaggaaaggacttgcaagtagaaatgtttcagcagactctcgcctcccccatctccatcctcactctgatgttaagtgtggggcccattgggccagatacaggtaaaaaggtgggtgatgtcattaaaaggtattgttacttatagcttattatatgtgttaaattttaataagaattttcttttttctttctcccaagccaaactggcaagacgcagtcaagaacgggacaatcttggcatgttggtctggtcacccaatcaaaatctgtcagaagcaaagtgtaagtcttggagcactttattttccacctttcttgtttaatgtaaggttttaaaggtacctttgaaggtaaaagcttctatatgtattaaatttcttttctattttaagataaataatttaaagagttttaaagtgtatatttctttttttaaaattttttattttttgagatggattctggctctgttgcccaggctggagtgcagcagcacgatctgggctcactgcaatctctgcttcctgggttcatgtgattctccagccccagcctcctgaatagctgggattacaggcacccattaccacacccagctaatttttgtatttttagtagagatggggttttgccatgttggccaggctggtctcaaactcctgacttcaggtgatccgcctgccatggcctcccaaaatgttgggattacaggtgtgagccactgcgccctgtgatctgttccatttttgaacatgttctttcttacagagcactaaaaatctgcctccctgtaatttgtaaaagctttgttttcctgaactttgctaaataagtttgcttccatatgtgtcctttaaatgttcagtcatcgtatctcctttactgtctgagtccaagctagttgcttcaggtgccttttcagatggtttttttggggatctcttttcatctcctgttgtccttctaagtgtgttccagttggccacaatgtccatcttaaattgtactcagaactgaatatgaagaatactgagcattttttgaacctttatgccagcacagtactaaaatgtttttcatactcctgtatcattcagtgttcacagtaacccaggaggaagattttttctctgttttacagatggcatcccatagttcaaagagtcagagggttgtaaaagtagcacagatagtgagtggcggaaccccaagtagttcactcctgggtcataatctcacttatttctcaggctgtgttcatttagcctgttagccactatctttctgttattacagtttaaagttgtattagtcacttttcctattgtattgcttattggagtctttggagtcagaatttaattttaatgttatcttatttttcatagacctagaagaaaagggcagaatatgtaaagttaattgatttttaaacagtggtgttgcctataaaataaatttacagttttattgtaagccctgattacaatcgttttaagtttaaagttggttaaaactttaaactttaaaaaaactaacctgtccactgaggctcccagtggacagcgagctcggcttgtggctgagacacacttgagccaggccagaggcataggaggaccaaatttgacagatatcaatacacgattcttactgaggcctttgaaacggacccttgtcctggaattactgtcagaaaagaaccggccagaaaaacagactcccgagccacgagtccaggtttggtttcagaattggagaggtggagcacggaaaagaagccagagcagcgccagcgtggaggccacctgggcgcaggtccccccgatcccagaccctggtcagcctggggtgctgacccctactgttccaccagcggggcttccccgggggtcccaagcaatgtgggcaacttctcttgggaatcggaggatgctttgggccaagctctcctctgggggcgcgctgatgttccgtgcgcgaatgtggcccccgctgacctggagatggcagccagtgcgctcggccacgcttagggagatgtcccttgatctccgccctcgggcccagtgctgcttccgggtccctcttgccaccagcccttcccacagctggaagctggcagtgctgggcctcaagttcatcccggggcacccggcctgctccccatacaccagtccctagctctgcgggggctggggctgcaccctcctgctgtggagcagcagccgaggtggggctggcagctgggggaggcgcctgggtgcgccgtgacctgggagcagccctctccgccccagcccccgcagctctgaccgtatcccgcctctctgcctctttcctggccatagtcacagccacagccatcgcaggacccggctgagcgctaggaacaggttccttgtcttcctccagaatccaactcgcacgggaggccccagcacccctgcccccaacccgctgcggagtctgaacctcaagcggctgcatagcaaacccgtggaaatgacctgtcagtgtcaggcagtggaagacagatgaactaagcaagggctcatcggtagtgttcacgttatgaaaattgaagagaaatatcaagatttatttactttgtcacggaagggcttccagacatacctttcagggaaatcgagttgttagggtggaagggccttggggtgcatgagacctaggggttttccttagatggcataaaaaaggattgactttatagaatacatctgtctttccatttattaaccgagtaaacacggagcactgagagtgaacaaagtccactagcgagaaggcaggatgaggacggctttgtagaaatgcattattttctatcaggaaagagcaatgatttctactctgggaaaaaaacaaaacaaacacttacctaaaagtaatatttacatattgttgaaagttcatagataaaagtataaagaataaaaaaaattcacctattattccatcacccagaggtgataatcgttaaacattttggggtatttcttccaattttttttgtatgtatttatataagtgagatgatagattatctgtgtgtgtgtatgtgtgtattgtcttcctgagcatcggacctaagcagtttccacgttgttaaaactgcttataaaggttttaaataactaggtgtaatactttattacatggatatgtcagtatgtttaacaattactctattgaaaatttaggtgtctcagttttggaagaatatggaagtcttggttgtccagcatttattctgacattaagtagaaataagtgatttaggacatatttctagcagatactaaaaaactgtgtataggatgtctggagatccctggcttttcttgtgtgtgtgtgtgtgttttttttttcctcttcttttcaaagtggctgttcagagttctgcctcttagggttactgaaagcttataaagttatgttgtaattataaaaataaatgctattttagaaaattcaaatagtacataatgcataatatataattgttttccacaaaatgtgaactgttatcagtctgctcataagtacatctgggactttgtttcatctcagtatatctacagttatctaatttttttttactgtaactagtatggatgtatcataatttagcctttttttaaacaaaattacctgtattacctattgatgaatatttataatcttagttctttttttaaactctgttttttaaaaaacctgatccgtagaatgactctagtttaacattaatgaattgtacatttcttttttttttttttgagacagaggtttattcttattgcccaggctggagtgcagttgtgcgatcttggctcactgcaacctccacctcctgggctcaagagagtctcctgcctcagcttcccaagtagctgggactacacacgcaggcccctgcacctggccttgaattgtacatttcagaatagctagaagagggctgagtgcggtgtctcacccctgtaatcccaacagtttgagaggctgaggcgagctgatcacttgagctcaagagtttgagaccagtctgggcaacatggtgaaaccccatgtctctcaaaaagtccaaaagttagctgggtgcgtggcatgtgcctgtagtcccagcacttggaggcagagatgaggatgcttgagctcaggagttcaagaccagcctgggcaacatagatctcccctctattaaaaaaaaacggggaggcgggggctagaagagaataattttgaatgttcctaatatagagaaaatgtaaatatttaggattatggatatcccagttaccctgatttgattatatgaatgtatcaaattatcacatgtaccctggaaatatgtacatctgatatgtatcagtaaaataaaatacatacattttaagagaggatcttggctctgttgtccatgctggagctcagtggcacagtcatagctcactgcagccttgaactcctgggctcaagctgtcattttaaaaaaagcaatagtgaagatttttgccccttaatacatttcttattttcttgtttaaaatagattttatattttagagacattttagcttcacagctaaattgagcagaaggtacagagtgcccatttatcttctgcccccacacacccacaccctcccccagtgtgaacatcctgcgctggagtccaccaaagggatacgtttgttacaatcaagcagcctacagtgacacattcttatcacccgaaattcatagtttacattaagcttcactcttgtgttgtatgttctgtggattccgacaaatgtataatgacctgtccaccaatgtagttatcatcgtttcactggtttaagaaacctctgtgctccacctgttcatctccctctctgcctcctaaaccctggcaactgttgatcgttttactgtttctgtagaatgccttccagctggaatcatatagtatgtagccttttcaaattggcttctttcacttagcaatatgcatttaaggttccactgtctcttttcatggctggatagttcatttctttttagtgctgaataatataccgttgtctagctatgccacagtttatctggtgtattgtcatgctaggaacccctctcccacccccacattacaaacagactgatgtcttctgtcgtcttctccttttttacatcgttgtttcaactgaaattattggattatattttttccttcacttacattaaactcatacatactttgtgcctggacttcattcttttcagtgtacctggctctatatttattcttttaggtgaatcttagatttgtggtaacaagttctgtccaaaagtatctcaattcagattatacggaattcgtgtttatctactgagttttcatttacgttttatattgaacagctttttgtctgggaatgtaccaggagtgaaaggttcaggaatctcatactgtaatggagagacagaaaaaatgaacatgtgagcaaataatttatgtgtagttttcctaggcaactcttcctttttagaggtagaaacactggggtctacagaagtaaagtcaagtgtttaaggtcccatagccagttattacagtagccaagttttagctagatctcttgtctccagacaatatttaccacacctgtctgcctttgtaggctgcttcatttaataaactgtaattcaacgcttaaaacattaatactatactagtttttttgggctgtgtctaagtaaaacccatttaatgagagatataacttatgggatatgcctagaaaatgtggcctgtagagagacatttcatgttgaggaagcgtaaataattcccaataacatagattagaacaatgagtttaaatattaagtgatcatggaaaattacttgatgaaaccatggcttgagatttcagcaacaaaggagtgaatgaagtacaatctgccatcatgtgtaatctggagggtggcagactgagaaactgaaaaatgttcacttattggagaagagtacagttgactcatatgatttttacatcaagcatctcccatgtaccactgagtcagtattctgatgttcccgttgggactcagcagaaggtgctagctttcctaggtagaaacaaagagttgaagatggttgacatttgattgaaatgtggaagaatgagtaggagtttgctggctggaccaggggcataagtgcacactagacagaagaaatgatagcatttcctttttttttttttttttttgagatagaggtctcgctctgttgcccatgctggagtacagtggcgtgatcttggctcactgcaacctctgcctcctgggttcaagcagttctcctgcttcagccctgcgagtagctgggattacatgcgtgtgccaccacacccggctaattgtgtgtttttagtagagacagggttttaccatgttggccaggctggtcttgaactcctgacctcaggtgatcctcctgccttggtctcccaaagtgttggaattataggcgtgagccactgcgcccggccagcattttcatttttaaaggtgtgaagatgtggagaggaaatccagcacttaattttggagatttgcctgactgtgacaagtgttgtcctggggcagagagaaatgaaactagaaaggcaggccagcttcttaaaggtttggaggatctcttgacggagttttagctagaactgatatgatttacactgaaaagctcttgacagtcctgtggtttagagaagagtagagaagaggtttattggtggtagtaaggtgttgatgcaattccaagtcagagaagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacatgcctgtaaagactattaaatgccgttaagtataggtgcactgttccatcatttactccacacgtttctgttgaacccctatgaggcactccgttgctgtgatacggtatcatctctcctcagtccccactgtgatattgtgcagccaccctttgcatggattccacaccctacctctgcacatcctgtttataccattccaggctgcccgcctttggggactccatcctcattccagttgatctgcaccctaaatgcccaccttgctcagccctacccaccagctttaggataccacctcttgccttcatgcagacaccactgcactgcgcagtgtacttttgacagtcccctcttgtcactgtgcttacgtgtagacctacctcaagtttggacttcgtttgtttagagaagcagctgaacgttaacaaagtgggcgtattagagtttaaaatatatgtagagtttaggccagattgtaggcccagtctggttccttttactgacttaggaaaaacaaagtttacccaggcacgtgtggttaaatataatgcaaaactgtggtccaagggtcttaatgaaatggatagattaatctgaggattttttttttgttgcttgattattattattttttttaaggtagggcttgaaaagaaggggagtggaactagaggggaagctcgggtatagccttgtctgttgtttatagtctgctttttaaaaatatataatcaactaaattgctcatgctgaatgatgttgatagttcccagaaggagcaaatttctcagatgggctgctgttgccttgggtgtagaatttagcaaggtgacttttggctattggatatccatagaaacagatggtcttgctcatttatgcattatgcattttataagttatatatagtaagtgtttgtgcagttatttaagtgtttgcattttgggttttttattttataaaaatgaggaaaaactggtccagtggtaagaatcatggatctctgtgttaaaatagacaaaaatggaaatcgttagctgtgccaaaaacaagctggctgatttttttgagacagagtctcgcactgatgcctgggctagagtgcagtggcgcaatctcagctcactgcaacctctgcctcccaggttcaagctattctcctgcctcagcctccctagtagctggaattacaggcacccgccaccatgcccagctaattttttgtatttttagtagacacggggtttcaccatgttggccaggctggtctcaaactcctgaccttgggatttgcctgcctcagcctcccaaagtgctgggattacaggcgtgagtcaccgcgcccggcctgattttttttttaagctagctattaactatataaggaaaaaaattgcatgtaacatggtggaggtagataatttaaagttgtgtcaaaagacaagtttaagttagggatttaaaagtaagttttagctttcttggaataagagccgtacctatgacatacgcacaattcatttctactttaggatgtttgacttactatattgtacatgaaagtttagagtaatatgaataatgtgtaatatatcatatataattctaaactttcatgtagatacatagtaaatgtcaggtgtctctattcagagcatcccagtagcttttcaattcattgtaagttaaagtcaaaagaacctgacacaccctgggcagcatggcaaaactccatctctacaaaaaaattaaccagtcatgatggtgcacacctgtagtcccagactgttgggaggctgagatgggaggatcacttgagcccaggaggtccaggctgcagtgagctgtgattgcgccactgcactccagcctgggcaacagcaggaccctgtcttaaaaaaaggaaaaaagaaaataataataacacaaaaaaagaacttgatgtccacatggctcaccccccagttcattctggttattgcttaagtgtcactatatcagagaagccttctttgaccacacaaaccactcactgtcttaactcactttctttcattctgcttatcatcaccggacatcgtattatctactttatgtctctcgtctctctccactgtagtgtaaaactgagtggaggaacttggtatgtgtgttcagttctctgtcagtcccctcttggcatgtggtgggtgtataataaataagttattgaatgaatgagaaggtggtgggagtgcaggattcccctggatagagatttgcaaatacaggcttttctgccatttgctctgtaacttgggttgtctggaatcttataacatttccttctttgtcccttaccttgtggctatcatttgtttactcagtaacttgcacaactgcttgtgtaccaagcgctagcaggcactggcgaaatacacgaacagtccgacaagtccctgcccaagtgtagcttacagtctacgggaagctgcactggtaaataagttcattgagcgccgtgaaggagaagtgtgcttaaacaaataccacatattctcacttacaagtgggagctaaacattgggtgcacatggccataaagatgggaccaataaataagacactggggactacctaggatggggagaggtggggacaagggcttaaaaagaacctgtgctgagtgagtcatgggttcatttgtaccccagacctcagcatcacgcagtgtgtctttgtaacaaacctgcacacgtgcccccgattctaaaataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagtttatcctttctgttgacagtggacatccattatcagttcttgactattacaaatattactgctggggaagcattcttggacctatttcttgatgcccatctagaatatatatgctaagttctgagagatcagtgccaaattattttcaaagtggtcaaactggtttacactgctaccagcaaaatgcagaatttatttgctccacatcctctccaataattgctgttgttggacttatacgtgttagaccagtctagtgtgagtataacactgtttcatataccaaggaattttgctgttttagttaggtctgttaatggcattggtgttatgaaacaaatattcccacattttaaaaagaggtgtatattgatatatgtagggatgaaatgaaataattgggatttactttaaaattcttcagcacatgtaaagcacattttgggatcagttcaccaaattgttctgtggatgcagattaaagtattgtttccgtgtttaatttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatatgcactctgattttaagcacaaatggttacatcttctatgtagtggttttcaactttaattttcctgcaattaaaaattaaaccgagttttgatcctgaataatatcacatcttgtagcatactttattcaactacatctctccttccttccttccttccttccttccttccttccttccttccttctttttctttttctttttttttttttttttgagacagtcttgctctgtcgcacaggctggagtgcattggcacagtctcagcccattgcaacctccgcctcccaggttcaagcaattctcgtgcctcagcctcccgagtagctggaattacaggcatgtaccaccacacctggctaattttcatatttttagtagagttggggtttcaccatgttggccaggctggtcttgaattcctgacctcaagtgattgacctgcctcagcctctcaaagtgttgagattacaggcctgagcttctgctcccagcccacatcccattcttgaacatttagatgttcttcttttttcctcctataaataacacaagtacacaggaatttataatgtcctctccccagttgaaaagaaagccctccttaattctgcagatcaggtttctcaattatgtgcattcatagttctttttctcggtcacttacgacaattggaattcatttgtatgactatttctctctctccagtcagacatgcgggttccataagggcagagattgtctattttaatcacagctatcaaagcagcaccaggcacacagtaggcctgaaagatttgttaaatcagtggagaataatttcaacataaacaatatattttataaaagatcactgtgttgcaacttactttgaaagctcttaaataacttgtttgtatagcagtgcttatggaaggctactctattggatgaagaatagaaaaccctccacattgcaaacagtgggacttaacagtgggagggcctgcccctcccaactccctctcacaggcaggagagcctgccctctcatactcagtctcacaatggggtttagcttccttttcagagctaaagaacccacccagccttcctataacacagactctctttcatctttaatggacagaatcaagattattgctgccagagatagaaagttggggaaaagtcctcgagggtccccttctttgtttggagcaatttgatgcaggtagcttgtatttctgtttatctgcttcctgtttcgtcttttatcttttatccatcaccttaagcatttatgcttttttttttaatcttaagaaatgggggttcactgtgttgcccaagctggtctcaaactcctgggctcaagtaatcctcccgtcttggcttatcaaagtgctgggattacaggctataagtgtgagccactgcatctggccaatcttttgttttttgtatgagggtagctggagcacttttaattttctaaggttaaaaacttacctttgcttcacttaaggaaaccatgtgagagatcttgaaaaatgcacttttcattttcatcactgccctaccagcaactactggtgtactctgccaagataagcttcagacaagtcacttctctggggattggggttggagactgacttattctgtaaagtgggattttaacaaactcccactaagaaatagctttaaaaaatttatttttttgagatggagtcttgctctgttgcccaggctggagtgcagtggcacaatctcagctcactgcaacctccgcctcctgggttcacgccattctcctgcctcagcctccccagtagctgggactataggcacccgccaccatgcccggctaatttttttgtttttgtttttgtttttgtatttttagtagagatggggtttcaccgtgttagccaggatggtctcaatctcctgacctggtgatccacccgcctcgtcctcccaaagtgctaggattacaggcgtgagccattgcgcccggccaagaaatagcatttttataaagaacgtacattttgttacctacttggaaggacggattgatgaaatcctcaggcagagtctctggcttggcttcctgtgctgttttccaccccagagagggagcgttcagatgtttactgtagtaatgtctgtacccaccaggtggcacaattgctttacttaaatgatttaagctcattttgattctcagcgaggtgtgataactcatttcttattttaataataaaagatgccacaatatttgttactgtatttttaaagagaatttttgcatgttcagttgagtgatgagagagaaattggtgtcatgtttcctctgtggtacctaatcctacagcaagagtttcaaaaatatttttttaaaaaagctctaagaaggctataagccttgtcatcagcccaccatatggtgccagcctattgctttgcatagaatatccaagatcacacagtgttctgaatatctgcagtatctagggggagggaagggtgagttaaggttactgtggcaattttcatctgcatttctcccttcttttgcacttgagacttactgagggtactagggcatttcgttcattgaattaaaatgaatatagaaacaattgaagtttagcgtccatctgtttcttacccctgctttctgtcacttcatcaaccacagttctattaacttcattcaagctagatacagtatgttgattagccttggttccctgtaccaaggaggctgttctaatctgaagagcccttctgcctctatcttctctcctcaagagatagaactgtgttggctggtccgaagtagtgagttatctcaactgattcttcacaattgcagatggaactccttgttcttctctcttcctgcttctcactactggacccagctggtcttttttaaaagaaggaaaggagggaaggagggaggaattgtgcatagaggttgtttgtttttgtttttgttttagatggagtcttgctctgttgcccaggctagagtgcagtggtgcgatctcggctcactgcaacctctgcctccctggttcaagcaattctcctgcttcagcctcctgagcagctgagattacaggcatgagccaccatgccctgctatttttttttttttttttttagtagagacggggtttcaccatgttggccaggctggtttcgaactcctgaccttgtgatccacccacctcagcctcccagagtgctgggattataggtgtgagccactgcgcccagtgcatagaggtcttaaaccttataccttatctgatatttaccagctgtgtgaccctagccagactacttctgtgagcctcagtttctttgtgaatgagagtgataatggaactatcagagaagattaaaaaaaagattgtaaagagcttaaaacaatggctcataaataataaattctcagacgttagctgttgtttctgcttgtcagtatagatgccgaacctttaggaagcattccttcattgatcattattatcatctgatgacttggcattcccatactgtcctacatctgtgttgttatttcgtgtgtttgttctcttctgttgcctgtgtgttgtctcaagctactgtgggaaatcggttcatttttgcttatttcggcttgctatttaatacagtgctttgttcatggtaagtttaattcagtacatgcttgattaggcttttggaattttataaattttcttgaagaatgaggatttcacattctgtctttaagtgatattatgaggaagcccataactcattcacctatgctctccataatggtaaaacgcagtggatggattcttgtgcttctgactgacagattggaatgtcggccaggttgcacaggcaggcctgctttgcgcaccctgtacactggggaagggtgatgggtgcaaatgcctgggcccatagaaacgtgctggcattttcttgagcagcgtggactttgctcattgtcctgattagcgtttacttcatgagtccctgccctcagtggctcctcacttccagattggtgaatttttaatcgataagggacagaattaagattgttgttgccagagttggaaaagtccccacggatccctcttttctttaagagcagttttttgtaggtagcttgtatttctcctgctcctcttccttcctgtttcatcttttattcactgacttttaagcatctgcttatctttttttttttttttttttttttataagggtagctgggaacacattttattttcttgggttgaaagctttttttttttgcttcagttaaggaaaccacgtgggaggttttgaaaagtgcacttttcattttcattgctgtcctaccagcagctactggtataactctgtaaaggaacagggtaggtggtgggaagggaatagcatcagggattctgaaaagtatggcagctatgcatgtcccttgattaaagaaaacaaaagctgaggattatgtagagcaggaatacagtaagagacaaggtctgtcaacagcattgcttgtgcagatggctatattctgagtaaactctagtccagaacattctgtgaggagaggaggaggagtacctactgtggtgtcattttcccagttaggtgataacctggctttattggtgagaactaattcttgggaaggtcagggcgttgctaaagataacatagtcatacagtgctgactgtgtgccatgcactgctagacaaactcattttattttgagacagagccagaatttgacccgggtctttcttaccctgtacataacctgtgctgccttttatcttgtgggacaggaaacctcatatgttgacattgtacataatacagcaccccaggcattcattcagcaaatgtctgtctgatttttgttggacattgggaacaatgaaaagaatgaaaaagtgtatatttgctagtaggtattagatggtaattccttttacaggttagagggctcctggtacattaacttacttcatcacaaccttccgagcacctagtagacacaccatgtgtcttcatttaagtagttactacagtagagtgctttcttcctttactttagatttgagtcatcagggtgatcttccaagaattttttttttttttttggacagggtctcgctctgttgcccaggttggaatgcagtggcacgatcttggctcactgcaacctctgcctccaggattcaagcgattgtcctgcctcagccttccaagtagctgggattacagacacgcaccaccgtgcccagctgatttttgtatttttagtagagatggggtttcaccatgttggccgggctggtctcgaactcctgacctcaagtgatcctcttgcctcagcctcccaaagtgctgggattactggcatgagccaccgcacccggccatccaagaaaatccaaaagttacatgactttaaaggttaccttagtaagaataccttattgtttacaatatggcagatgtcctatataacctcagctgcagcattcgggatctactgttactgtcttgttgttcctgtcaccagctgattcttaagatataaagcaaaagaggagttgaaaatggagtagcattcaacaaatgcttgtgtgtgtcttaaaatttgtagctaaatctggttgcagacagtgggcacaggcattacaggccttgttactgatgtagcaggagggactctgagcagataacatatgcccaagaaccacaggcaggactagcccctgtgctgggccactccagggactcctgcatcactttttcagcctgtgcatgtgtttgctcaaagatcgtgctactggtgatcatacatacattccttactcagttaaggtagataatagtgtgctctgagacttgagatttacagcagaagcttaaggttcatttgttgttcattcaccaagtatttattaaaggaaggaacccttcaagccagttttaaacaagcagaccttctccagagttgaccctcaatttaccgcagattgttttcgccttctgtccttacatattcctgagtgcatctcatgacctggtttttaatcagctggcctgctgtctgtttctaggtctggtatgctgccatttgcatctcatctcctccagtatgaacccccatattacctgtgtctctctgcagggttctggccaggtatacagaaccacctgttcgagcagcctcatctgacattttttagaatctgagagcacttttatttggcataatctaatgtattgtgaaggaaaaagcaagggacacactttggagtaattccctgccctgcctttttttttttgagatgaagtcttgctctgtcaccaaggctggagttcagtggcacgatcttggctcactgcaacctcagcctcccaagtagctggaactacaggcatgcgccaccacgcccagctaatttttgtatttttagtagagatggggtttcaccatgttggccaggatgatgttgatctcttgacttcgtgatccacctgctttagcctccggaaatgctgggattacaggcgtgagccaccgcgcctggcctctgccctgctttttaaaatcaccagttatacttttgtgacaagctatggtcatttcatttgtcatttgctgaccttcaagtaaattgaaattttactgtaatctgagtgaagtaaccagtttgtaactattttaaatattaaatcggaaattagtggcttagtattagaattaatattgagctgcagtatataattagttattgtttgaattaggttgactttttcttttgtcaatggaatatttttccccaatttttagaatacatgcttctataagagttggaattctttttcaaaattgatttctgtttcctaaattggttgacagttctcccagagctgggagcatgcttttggtataatcgcatggcaaactaagttgtagaagctcagacttttattaggactcctctgtttactctttgtgtcatagtgggaaagtggatcactctgagcctgttttctctaagtttggccattgtacctagagagtaagatttaggagccaagagggaataggggctagtcaggattttactgcctacttcatacagttctatgctccttgattttttttttttttagcttgtgttgttgttatttttttaattcataaaggaaaatcatgcatgaacatatggcagtgctattgactagtgcattattttttcttgtacacttgggaagaaagactagaatatcctcagggaggaaattgattcatctttgggggtggcagcttctcctagaggttgagtcaattcattttccttggtattttccatggttcttgaaagctagccaccttatattggagtagtacatatttgaaagcaaataccaagcactgggtcacgtaatctatctcttaagaattttttaaaacataaagaatagtttgttcattattcaacctgagctgaaactaaaaatgacgcccaatttcatatttctttttactgctagacatgttgtttaaagtagtacttgtttgttgtagaaagttttaagtagaactaaagattttgtcttccttttccctttttctttttttgagacagagtcttgctctgtcaccaggctggagtgcagtggtgcaatcttggttcactgcaacctctgcctcccgggttcaagcgattctcctgcctcagcctcccaagtagctgggattacaggcatgtgccaccacacctggctaatttttgtatttttagtagagatggggtttcgccatgttggtcaggttgctctcgaactcctgacctcaaagtgattcgcctgccctagcctcccaaaatgctgggattacaggcatgagctgcagcatccagccctgactaattatttttaaaaattatttgtagagacaggatttcactatgttatccaggctaatctagaactcctggcctcaagggatcctcccgcctcagctttccgaagtgttaggattacaggcatgagcctttgtttttctcttttaaagaagactcataatctcatcaccaggtgatactgctgttaatatttgagaatattcattcagacgtttctctgcaggatcaataactattataatggttctgttttgttactgtgtgttctttatttttagtcttgtacaggacaagtgtattagtccgtttttatgctgttggtaaagacatacccgagactgggaagaaaaagaggtttaatggacttagagtttcacatggctaggaaggccttacaatcatggtagaaagcgaggaggagcgaggagcaagtcatattttacatggatggcggcaggcaaagagagcttgtgcagggaaactcccctttttaaaaccatcagatcttgtgagacttactaacaggagaatagcacaggaaagcccatcctccatgattcagttacctccagttgggtccctcctacagcacttgggaattgtgggagatacaaatcaaaatgagatttgggtggggacacagccaaaccatatcagcaggcctgaaatatacacgtatatcaattctagcagaccatagggtgtactctgtccctcagtttgtttaatggcatctcttcttgtttttcagtggatgaatacattgccattgccaaagaaaagcatgggtacaacatggaacaggtaatatcatggttttctttcttttgctgttaaaaaatgagtatttgtaactaaataattatatttttttcttctttgtattgagtagcagtgtttcttcattagcaactttttggtaattactagtagtgttacacaaactctggtcttctttttcttgttcaagatgaatattagaggaccctttgatttgaaaggcatatctgtcatctgcagatctacagcctttaggacactgattacttagtgattactaaggagctggatgcttgagcataatgctttctcatttgaatatgtgatttgtttgtcattcttctggttgtatcatgatgttttttgacgcatgttttcacattcttacctaaagtgttttaatattcaccattttgaatcattttcagtttgagatggagtctcgctctggtgaccaggctggagtgcagtggcgcatctcagctcattgcaacctctgcctccggggttcaagtagttctcgtaattctcgtgcctcggcctctcaagtagctgagattacaggtgcacaccaccacgcctggctaatttttgtatttttagtagagaaggggcctcccaaagtgttgggattacaggcgtgagccactgcgcctggccaagattttcttttaaatattgtttggaatgtactaataagaaatccacaagatttatttttctgcaaaagtgtggtgataccttatttcagctttaatgatttattttaaacacatcaagttggattaatgctttccatggcattaatctagatcttacaacctggaagttactgacatttcttatttttctgaatgatggaagttaccaagagtttagattatgtgaaattgtaccctttcttttggacttggccttacatttaattactctatcctggtcattgaagctacttttgattgcaaaatatacctgtatgaattcttaaggatggtagtcttgatcatttctcctttaaaaatgatcattagcatgaaaatttcctatattataattccagcataaaaattaccattagcaaagtattgctggatctcatcttacctcttttgttgcttattctatttctactttttttctttctaagctgagaagacctttatatatcatatatataacatataaatatatataatttttaaaataaaagaataacagcaattgttctttcataaattacttttttcatttatatattgaggcagtaaagtgtgatacttgaagagcacagatcctagaactatgctggttctgtgaccagaggcagggaaaggcagtgcctcagagaagaccttcagtttatactcaggctgatcctcacaatggaggcaagcctacaaccaaaagaaaacaaaactgtagtaaaaacatagcaaaccctgaggaagagtgtgattatgagtttactacattattagattcagatgtccaggttttaacagaaaaatcacagagcatacaaagaaatggtaaagtatgcccattcagtagaaaaaaattaatcaacagaaactgtccctgggaaaagaccttagtggcagatctactaggcaaagattttaaaacaactatcttaaagatgtttttaaagaactaatggaagatacagaaaaaatcaagaaaatgatgtatgaacaaatggaaataacagtaaggaaatggaaaacctgaaaggaaaccaaaatgaaattctagaccctaaacacttgaaatgaaaaattcactagacgtgctcaaaggcagattggaagagtctcaacaaagaacatgaagaaaggacagtggaaatgatttgagtctgagcagcaggatgagaaaagattgaagagtgaacagagcctaaggtaccctagggacacaatcgggtggactaacatatgcatgtggaagttgcataaggagtaagagagatagggacagagagattacttgaagaaataatggccaaaaatttcgcaaatttgttgaaagatgtgaatataaacaaacatccaagaaactcagtgaactccaagtagaataaactcaaagaggctcaccagagcacataatgaaactttgaaaagacagagaatcttgatagcagcaagagagaactaacctattacatataagggatcctgaataagcttattagggtatttcttgtcaaaacctttggaagccagaggcaatggtctgatatattcaaagcagcaagagaagaaaactgtcaactaagaattctatatctgagaaaattctttcaaaagtaaaggggagaaatgaagatattgtcagttaaaagctgccggagagtctctctgaagagaccacagtggagctgaacttgccaactggtaatcccatggtctataaattggacaagaacttgaagcccatcaagcccatgaataaaaaaagttcctggggatgaagagaccattcataaagccatggaagctgtggctgcccagggcaaggccaagaagtgaaggccagcaggctgactgctctctcaaggagcactctccctgcccaacccattcttcttcacctccctgctgcacatgccacaccgaccacatctgcaggcatcttacgttggagctgcagatgggaactcatggctcccattttcattgtaatcagttttgtctcctgcacccactcccttcatataatctagtcagatagcacctctggtgcagggagaaagctcctcttatccaagagagttgagaggtagtgactagggcttttgccagggcttgtttactaaggacctttgtgggaggaaccatgctgtcatgaccaaagaggagaagcaaagagggcctgcttgaccccaggacccaatcctgtactcttctctagtcatgccactgtcaggagagctctgctcattccagtggaagatgacagtaacctgcacggtgatgtgaaaaaacaacgatttcctccctgatcccagggtaggtggctctagaaggttgagagcaatcctgtattaagttcatgtgttggatttacttttacaaaaaattgtatgtataaataatacaaaacaaaaacccttctgagattttttattttatttttttgagatggagtctcactctgtcacccaggctggagggcaatggtgcgatctcagctcactacaacctccgcctctcgggttcaaacaattctcctgcctcagcctcctgagtagctgggattacaggtgcctgccaccatgcccggctaatttttgtatttttagtagagacagggtttcaccatgttggtcaggctggtctcgaactcctgacctcgtgatccactcacgtcggccttccgaagtgctgggattataggcgtgagccaccgcgcccagcccccttctaggatttttagtggcagttcaaatagtcccacatgtggtcatcagaaataagccattccatcctggacaacatggcaaaatcctgtctctacaaaaaattaaaatcagccaggcatggtggtgtgtgcctgtggtcccagctacttgggaggatgagatgggaagatttgttgagcccaggaggttgaaaccagcctgggcaatatggtgacacctcatctctaaaaaaaagtttaaaaattagccaaacatggtagtgtgtgcctgtagtctcaattactctggaggttgaggtgggaggatcgcgtgagcctagaaggcagaggttgcagtgagccaagatcatgtcattgcactctagatcacaactctatatcaacaacaacaacaacaacaaaaaaaaagaggggggaaagaagccattcctcacaccaatatgggataagctccttgacctctaagggataggattgcatcctgctgtgggttttcgaatctctcccctaccttgttttgtggctgtgaaatgcctcatgatcatgtccaagtatgtctttcactggctgatttccgaatcacgttctaattgcttggccctgccatgtggacccagtattcattttgagcataactgtactaaatctttctttctagatcagtgtaataaaggtgtaatgtgcaacttaaaataaataaaagcttgtgtctttttgtttgttttgttttgagacaaggtcttgctctgtcatccatgctggagtgcagtggtgtgatcatagctcactgcagcctcaaacccctgggctcagtcaagcagtcctcctgcctcagccccccaagtagctgcagttacaggcgcgcaccaccatgcctggctaacttgttgttgtttgtttgtttttcgtagattcatggtcttgctaagttccccaggctggtctccatgttctgagctcaagtgatcctctcacctcggcctcccagagtgctggggttacaggtgtgagccacaacacccagcctcagaaaatagctatagaatatatacacaaggaaatagaaaggaatttaaatctttcactataaataatcaacaaaacataaaaaggaggctggatgtggtggctcacacctataatcccagcacttcaggcagatcacttgagctcaggagttggagaccaacctgggcaacatggcaaaaccctgtctctacaaaaaaaaaactagctgcgcatggtggcacgcacctgtagtcccagctgctcaggaggctgaggcaggagaattgattgagcctggaagggagaaggttgcagtgagccaagatcatgacattgctcctccagcctgggcaaggagagtgaaaccctgtctcaaaaaaaaaaaaaaaaaaaaaaaaaaaacctaaaaaaacagtaattcaggaaatgaaggacataaaaaactttaaggaatgtacaaaacaaatagccaaatgacagaagtccctccttatcagtgattactttaaatataaatgggttaaactttccaaaggacagagattggcataatgggtaaaaattacaggatcccagtatatacaagagatttacattagttccaaaaacacaattttaaagtgaaagggtggaaaatggtatcccatgcaagtagtaaccaaaagaaagcaggagtgattataataatatcagtcaaaatagactttaaatttaaacaggttgtaagagacaaggacattcactgttggtgggaatgtaaaatggtacacctggtggggaaaacaggatggcagctccttaaaaaattaaaaatagaattaccgtattatccactaattctacttctggccaaagtgggtagatcacttgagcccaggagtttaagaccagcctgggcaacatggcaaaaccctgtctctacagaaagtacaagaaattagccgggtgtggtggcatgtgcctgtatcccagctacttgggagactgaggtgatcaaggaggattgcttgagcctgggaggtggaggttgcagtgagtgccactgcactccagcctgggtgacagatccagaccctgtctcaaataataataataataataataataaattttttaaaatttattttagaagaattatttatagtttctctgtgaccacttccctgatgatacatatgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgactggaccctccccacccaccccagtccctcttgttgggactcccaaaagattagacccatacgaaggactttttttttttagacggagtctcgctctatcaccaggctggagtgcagtggcatgatcttggctcactgcaacctccgcctcccgggttcaagcgattctcctgcctcagcctcctgagtagcttgggactacaggtgcgtgccaccacggccggctaattttttgtatcttttttttttttttttgagatggagtctcactgtgtcgcccaggctggagtgcagtggcgcgatctcggctcactgaaagctccgcctcccgggttcacgccattctcctgtctcagcctcccgagtagctgggactataggcgcccgctaccacgcccggctaattttttgtatttttagtaaagacaggatttcaccatgttggccaggatggtctcgatctcttgacctcgtgatccacccgcctcggcctcccaaagtgctgggattacaggcgtgagtcaccacatccggcctaattttttgtatctttagtagagacggggtttcaccatattagccaggatggtctccatctcctgacctcgtgatccgcctgccttagccacccaaagtgctgggattacaggcgtgagccgctgcgcccggccttaaacatttgatttttaaagattacttttttatttaaataaaccaactcattttttatgtttagcttccagataaatctatagcaagtctggtgaaattttactattcttggaagaagacgaggactaaaactagtgtgatggatcgccatgcccggaaacaaaaacgggagcgggaggagaggtgagcacatggctggggtgttgtctaaccacttaggggactatctaagagccccagatacacaaaggcaaggcagaatgactggttttccctccgcgccttcctggtggaaccacatgttcatgagatgtattagagcgtgtcacattattcaggtattttttctcaccactctttccctgcagtcagtgaacttccattttgagtcagttaactttgacccattttttttccttcccatttagaaggggtggctccttttaataaaaaagaatcttttattttgtagtttgaggtttaacgtggtatatttttacaagattcatttggtgtgtttttatgtttgccatgtggaaacaaaaatacaacttagagttgctgcttctttttttgaccatctgttttttgtgtgtgaatgagaaagagaaacattttataatctcttagtaaggatattagttttaaggatagctcagtatggagaatacttcttaaccatcacttcctcagtcttatatgtagcatagagaagtagaaatggccaggtactcacactcagaaatgggctctggtctcagctctgaagattccacttacatgccacaggctacactgggatgtttaaggtctttaatttattttttaaaatgtgtaaaattgtacatactcacaggcaggtgacttcaacatgcgtcttccccaagcttctgttttccttaactctaaaatgaagatgtttgaagtccagaaggcagcatgcagacctagtggtttccttgttagggtggtgagatatataggtgggttttaaaaaatcctattttccacatttcctgtaatatttttatcaattaataataaaaaaataaaatgaaggaggatgaaatatatggtccccggtgtcccatctcaggatggaattttatcatttcaaatgaaagagtaacatgtgagaacacattgaaagttgagtatcacttttggagaattcaaacctcttggcccaagtataaattgagagtgatgttaagaacatctccaaagctcttttaattgtaagagcctataaaattatcgaccatgatacatctgcatatttttgcctctgacttatatactagtaggtttatttatggatgagtactcttattaacttttaatgaagctttttcatttccctagtttactgtctatatagtaagtctgttactataagcagatgcagtttactaagcagcaatcaaaattaaataatacagagtgggattggatatccttgagtgtgaaataagaatacctgccaacacttccattcttactccctggaggctttttttttgcattagtcccgatggggccaggaagtgctttgcctccacctcccatgtgcacctcaaccacttttgggatgcggggatggaggtgctgcagcagcacctgataaattgttggctttctaacaggacttgcctgtgaaagtcatggcagggactgggacaaaattcccttagccgaaggctctttcttgttgtggacactctttcctcagctagagcttcctgctaccttggtggaggatggggaggaggtggcgcgtagtgggcatggtcccgtgggatggattccagaggcagtgcgaggtgggcaaactggggcaggctacttgacttctgtagacttagttttctttttttacagttgcattcctacctacatcggggcttttcttgtttctttgttttaaattaaatgaaatactacattcaggatattacaaaaagcatttaaagtgctataccaatgtaagttttctttttaaaattaaacataattttaaaacatcagttgtccaggacaccagaaaagcctcagactttgtgtggccttgggtagaaagacggtacttggaaaaggatttttttactgttagcaggtttattcccaatgcagtggaaatttattctcccataatttctcagttttgtttagtaatcatatcctagtcctcaatagataattatgagaaaataacatgtaaatgcattttcattttgatattttcagtttacagatatagagcaatagtgttttagatctggattgggaagttaggaatctattttagtagtttctcatcacttagactgaaagaactatggagttggtattctgtttgaattacaaagatgtttttatctcagcagcctgaaaacatactaattttatattaaatcagtttattatttatatttggtaaaattagtacaaaattttcagttaaatcaatttatcgtttgtattcggaaaattagtacaaaataatcattcagtaacttgttcttgtcttccagcgaggatgaactggaagaggcaaatggaaacaatcccattgacattgaggttgatcaaaacaaggaaagcaaaaaggaggtattttttccccctagtattgtttaggcgaataaattttattactagtttcataaataaaacattcatgttgcttgttctacttaatatattaagtgctatgtggaaagcagcatgatatgactatttttcaacaatactgtctttgctttatagattgtataattttgtttgctaatagatatgaataaaggaaggcttaaaggatagaaaatagcactaatgagtaatgatgttccctagaacagcagtcctcactgactttcttcgtaagccattagctcagtaggttaacaagtggtctagtgaattccaggcagccttagggtctccattcacgctatagatgccccagcgtctgcccatcctaggcacccatgccgtgcctggggtgactgcagggagctggcagggactcggcacagccctcctgttactcagaagcagcaatttggtcacaccagggggagccaggaccatcctctctcacatggtgactgtttcatcttatcattttaaaaaatcattatacaagagattgtagtttctggattcagggggctcgtgaacctctacaattgcatgtaacttttacataggttcatagaggtatttttccaaagacacagtctatagtttcaaaaaaatttctcagagagttctctctctctgctccaaattataagaatagttattattttaagcctataaaaacagaagggtctaaatttatctaaactttaaaatgacatcagtaatatatgtttcttatagacaaggtaggaaatacagctaactgaaagaagaaaattaaagtgatttataatattatccataatcactgtcaaccttttggtgactttttcctgagaactctttctgtaaaatgtatatgcctgtatattcataattctgaatctagtcactttttaaaaataatataatggaagctttgtaatttttagaaccttttaaatttactctaccttgattttttttttctcttttttcttttttgagacagggtctcctgtgtcacccaggttggaatgcagtggcaccatgactcactgcagccgccaactcctgggctcaagcagtccttccactatggccttgcaaagtgctgggataacaggcatgagccacctccagcccttgattttatttttttttattttgtttttgagacagtctctcactctgttgcccaggctggagtgcagtagtatgaccttggctcactgcaacctctgcctcccagattcaagtgattctcctgcctcagcctaccgagtagctgggattataggcacatgccaccacgccctgctaggtttttttttttgtatttttagtagagatggggtttcatcatgttggccaggctggaccttgaatttttttttatgtcaaatatatttgtatacgtagctatatattattctgtcacatgaatgtttcataattgagttaccttatcctatgtggatttcccagttgtttattcctcctgttttttgcttttataaacaatgctggattgattctcacataactcactatctgtgctcatagatttttttcattagaaccgattcctggaagttgtattgttgagtcaacgtgttctagatacattgttaaggcttttttttttttttttggttgtatatcaccaaattggaaattggtcgtttttttctgcataatttatatgaatgcccaaataagatcctgagggttagctaaattagattgtttgggaaatcaaattgtagttgtagtttttattaagctttgtgttgatgtattgctatttactaggtttttcagtggcacattttaaatgagagaaaacacttgatttcatacatttttataattcttatttatataatttctgattcagaaagaaaatggctaaatcattgttttttttttttttttttttttttggagatggagtcttgctctgttgcccaggctggagtgcagtggtccgatctcagctcactgcagcctctgcctcccaggttcaagcagttctctgcttcagcctcccaagtagctgggattacaggggcccgcaaccatgcctggctaatttttgtatttttactagagacggagtttcaccatcttggccaggctggttttgaactcctgacctcaagtgatccacccacctcggcctcctaaagtgctgagattacagccgtgagccaccacacctggcccgtagtttcttttttttttttttgagacggagcctcactgtgtcgcccaggctggagtgcagtggtgcaatctcggctcactgcaagctgcgcctcccaggttcatgccattctcctgcctcagcctcccgccattctcctgcttcagcctcccaagtagctggggctacaggcgcccgccaccgcacctggctaattttttgtagttttagtagagatggggtttcactgtgttagccagggtggtctcaatctcctgacttcgtgatccgcccgcctcagcctcccaaagtgctgggattacaggcatgagccaccatgcccagccacctggcccgtagtttttttaagtattaaaatgatactagaacagacgtagtcagttggtgatctttattaaacatcgtagtcccatacacagcagtttattgcctactaatatttttgtattacccacttgttgaagaaattatcactaccattatagttttgcagtgtctttagctcagtcttttaaaatatgaagcagaaagtcatattttcagctttatcagtgaatgctaatgcactaacaagatggaattatgagcaattataaaaacttcttgttcttaaaatggttaccagtaagttatattctttaacttgacaagattttactgtgtttcatttctgaaagttttggttttacagaaattaatagccgtcatgcattttaaaatgataaggtatattattttagagtaagttatataagttgccgtaaaaattgtgttatccaaaaatgtgtataaaaagctgtaatttcatgtagctaaatacagatgtgtgtgtggccacaaaactcattagcagagaatacagatttttttctttctatattactagaggaagctgagaattcttattttcattggcttgaaacgatagagtaaggaagtatttgtacaagaaggagtggaacacagtttcattgtgtttagtcaaaactcagtagcccaaattctgtctgtgaactgcctgttagaatttatagatctcatttggttctgatagggcatggtatttgtcttagattgttttggtgccatgttaaggaaataaatatgtttattactgatcatttgactttttttaagtttcattcatcacctgtgtatatcatgcaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacaggtactcataagcctggtcttggatgtaaaagaattaattagcactttagaggtgtttctgttattcatatatgtgaatgttctctttccgcaaatctcaaaggagcattttgtttcgaaggaattggacagatcttaagtaccagcccattgtttttctttttaatgaacatataaattgaagtgtatggatatagtgtgatctgaaagtatttctgaagtatatagcaaagcatatgaatatcatatttatattatatatgtgtctgtgtctccatgatttctcacaatatgaacataccctagtaacctgcatctggatcaaaaaatggaatgttgcccccaggcccatgcattttccctcctggtcactattccatggaatgttgcattccctcagcaactccacccctcttttattacctgactcctccttgtaggtggccactattctgattttttttttttttgagacggtgtctcgctctgtcgcccaggctggagtgcagtggcgcgatcccggctcactgcaagctctgcctccccagttcatgccattttcctgcctcagcctcccgagtagctgggactacaggcacccaccaccacgcccagctaattgttttttgtatgtttagtagagacggggttttaccatgttagccaggatggtctcgatctcctgatctcatgatccacccgcctcggcctcccaaagtgctggaattacaggcgtgagccaccgcgcccggccctgattttttttaattttattttgtttttgagacagtgtcttgtcctgttgcccaggctggagtgcagcggtgcgatcttggctcactgtaacctttgcttccggggctcaaatgatcctcccatctcagcctcccaagtagttgggagtacaggcgcttgtcatcacacctggctaattttttgtgtttttggtagagacggggttttgccatattccccaggctggtcttgaactcctgagctcaagtgatctgcccgcctcagcctcccaaagtgtactgagattacaggtgtgagctaccacactcggccctgttctgatttttaaaaccataagttgtttttgtccatttttgaattttatataaatgaaagtcatgtggtactgtttattttatgtctggctttctttcaacctgagagctaaacagtttttcaaagtggtcctgtcattttatgtgcgttttgtttgcacatcagcgtttcccagctgtagcactatcctcatgatgggccgttctgtgcactgtaagatgttgagcagcatccctggtcttgacccagtagatgctagtagcaccctcccctaccagttgtgacaacagaaatatccctaggcatcaccagattacctcacaggggcaaaattgtccccatttgagaaccactgctctacatcattgccatattttggtagtcttaaattttagcccttctgatgggttataatgatgcctcattgtactttttatttggcagttccctgatgactaatgaggttgctcaccttttcatccatttgttggtcatttggatatcctcttttgtgacatgtctactcaagtctcatctgttttttttctgtcaggttgcgtattttcttattggtttataggtgttctttaggctctgagttgttttctacaacttgtattttaaatgctgtaaatatgttttgcattctgtgactctcaatggtatcttttgatgaacagtaattcttcattttaaggtagtttagtttcttagtcttctgaggttagtgtttttgagttctgttcacctttctcaaggtcatgacgatattctctcatgttagtcttagaagtgttgttttaccttttacattttgatctagaaatgtttttctgtatttgttgttacatgtcggattaatagtcactgttttgttttcatatgagtatcaatttggtcaagtatttattgaagaaactgtcctttatcctttgcaacgcagcaggacctttgttttacatccagtgtctgtatgcatatgggtctggtttgaggttctctgttcctttaatctctttgtccatccttcaccaatacatactgtcctaactttatgtactttattaatttagttatctggtgtaatataagttctccaagattgtcttggttatccctggccttttactttccatataaaatttagaattactttatcaattttcagaaaaataattctattagagttttgattgggattgtattgcatctatagataaaaatggagaattaacatctttattgagttttctgatcagtgaacctgatatacccctctacttctataggtttgtaatttctctcaatgttgtattgttttctgtgtaagaacttaacgcatcttttgttagtcattccatgatatttggtacttttttggtgctcttgtaaaggatattgttttttaaattactttttataattatttttgcctgctatgtagcttattattttaatctgattgcatagtacatttaaactgaaaattcaacctagtagttgggtcctgtcctttcattctctctctggaattcagtttccagaaatccatcagcaagttgttgactgactatttttggtttttgctgcttttgatttatcttgatggttcccttggaaggtcaaacagtagaccaactgtcatctcatagacgcgaagagcagggcgtgctgctgtctttcttgtggtttagggaggcagcccagaccaggacccaagcacactctgtgtgctcagaggagcggcttcttcttgtggctgctggcacagctgcactctaatcttaggagaatcacttaatctttctaggcctcttttcaaatgagattaatcctggcctgcctgatctcacagaatatgtctgggctactgtgtgagagagcatttgaagttctgtttgcactggaagaactgtctcgggctgtgagctcttgttgacattgtcatcttcctttacaaggatgctcctttctccctctgctgagtgagctcctggtggttgctgtttaatatattgagaaaagaaaaagaggccttcctcttgcaccgaggtgttattgactccatagggtgagagagaaaagattctttagttttcagagcagggtcaagagcaagaatttttaaaatttgaaggtcgctcacaattatgaagagggaggactcagcctcactcagagaggaggtgggtgatttcctttccacagccttttagcgccacagtgcagcagtgtgttcattgccaaatgtgcttctagactcaaaatgggcagtcagtccacttgggccacttgttctggaggccgccatgtttggtatatcaaggatatattctgaaaataacagcaaactcgactaacaacagcttaaacaatttagggtttatttttctcaaatggcaagaagtgccaacatcagtggctactggtgttagttcatgtgttcagtcatgctctcagggacccaggtacttttcaggtcttctactgtgccattctcagctgttggcttttcatcttgcttgttgcctcatgttggaagctactggagccattttgcaaccctcacatctgcattcagggcagtatgaagaggaggtgggggtggaggtaacctgtctgtcccttttagcaggacaagcaaaagccttaccggaagctccttagctgaattctgtgtgcccgtgcgttgcgtactgctcttcctccttcccaagacatcatcaacctctaccagcgagaagggggctgggcatgtctcttaaattagccagtgaacagtgctggttgcatcaggtctttctctgagtggagaataaagtgatctgatgttaaaagaggaatcactgtgcccacagtaaagtagaaaacagaaagttctgtatgactgagggttgggtgggagggtggtgtctaggtagggcgtcaggacaagtggatggcttttctttttcatcttgttttttctttaagtgtgattacctttgcatcctatttcttacctatttcattgccactcactttccagttagcatgatggtggcagtaatctctgtttttttcctgcttaataaacactagatgtttggcggggggaagggggcgtattttgttttttggagacaggatcttgctctgttgtccatcctgggactgtagtgatacagtcatggatcacagtagcctcaaaggcctgggctcaagcagttgcccacctcagccccctaagtaggtaggactgcaggtgagcaccaccacacctggctaattttaaaatttttttggtagagacagggtcttgctgtgtcacccaggctgttcttgaactcctgggctcaaatgatccttcctgccttggcctcccaaagggctgtgattacaggtgtgagccactgcactagcataatttttttttggcagggtctggcactgtcacccaggctgaagtgcagtggtgcgatctcggctcactgcaacccctgcctcccagactcaagctatcctcccacctcagcctcgcaagtagttgggactacacagcctagatatttcttcttcttcttcttctttttttaaaattatactttaagttctagggtacatgtgcacaacgtgcaggtttattacatatgtatgcatgtgccatgttggtgtgctgcacccacttcgtcatttacattaggtatatctcctaatgctatccctccccactcccccaaccccacgacaggccccggtgtgtgatgtttccccatcctgtgtccaagtgttctcattgttcaattcccacctatgagtgagaacatgcggtgtttggttttctgtccttgcgatagtttgctcagaatgatggtttccagcttcatccatgtccttacaaaggacataaactcatccttttttatggctgcatagtattccatggtatatatgcagcctagatatttctgatacggaaaatgcatcaggaagaggggtataggctactgagcatttagagctagcttttagttcagaattttagatgttttgcatttactctctctgcttcttttataacgttacttaatcacagtgcaatatatacccagttttgtactatctatgaacaaccagctagagtgacaagagtggtctgtttcactggaatgcgaagaggacatgtaatattctaaaccttgactttttcctgccaaaagttgctatgttgcatttttagccaaaaaggaatccagtgaacataatctgagtactttgcaattttcctgggttttcggtaactgaaagaccactgagcaagatcctaagagattgtaatgtctagcatggcagccagcagccccatgtgtggttgtttaaatttagattaattacaagtgaaaaaaatttaaaaattttcgggtagcatcttctactcatgaatgtcttttacattttacttgagaaaatcaagctcctcttccgttggctttcttagttgcttgtgtgattattcaaagatgaaaaatgctggagttcagagttccctggtgcttgacacggatatgccctctacttggagtagagagaaaatagcatacttccgtgacctgtctcattcaagggtccatgggaaaattaaggagcagccatagcctgggaggttggtattgtttgtggtctttctttcgactgggtaaggacagtgaaagattaccttgagccaaggcagtaatgtggaaaaagataatttgtaggaaagtgaagacgtgacagttaatcaaagttagacttctggaaatctcactgacattgtgttttcctcgcccccccatcattaaagaaatctatgcttgtgcacttctgccctgtgtagaagcggtggacagcacagtgatcttggggcgctgtgaggctgcacccgcagttctgttgtaaagactgggcctttttggtccttactgtggctgctctgttacttcagttcaatcctatgtggtagtaagcccagggatttcttctgtcttttatgtaagactccaggtaggtgttttgctgctcaggtatcacctgttaggaagctgtggatccaggactgtgtacgtgagagccctccgtcccctcctccttgggttgtaccttatctgttgctctgaacaagcaaataataaacctagttagatgcttcaaaggataccatagggatctcagaattcagctacaacagatgttagtaacgtctttactcttgggtttttgtttctttaggtttttaagttctgttttcatacctttatatagtttttatttttaaaatgaaaattattttttccttcctagatccagaatattaaacagacaaacagtgctctcaaagaaaaacttgatggtggaatagaaccatatcgacttccagaggtaggattatgttaacatcatcttagaagtcatattcaagttttacatgtttaagaatttaatatcggtgtgatacatccccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgactttaaaaaaaaaaaattttttttttaatggaaaaaaaagagcttaggagcattggtagattttagggaaaagttacgtcctgccctactcccagcacctagattcttggacaattatgtcctagtggatatcattttagccaaattactgtattcctttgggcttttttcttttcctttcccacttctcacaagttgtaaaaacttaaccgggaaccctgagtcttctaaaggtgtatttcattttactagttactcatcgagctctgactagccaggaagtacaaaaccccaaaagaagcagacagagtgttcagctttaaaggttgggggtgctctggacctgcgataccaaaagatgaatgcagaatgtccccaaccctagggcaattgctgggtgacttcagctgttatgtgacatgtaatgggaagacagatatcaaaatgacagggtcggtcatctccagaatgtgtctagaattggctggtactttttcctactctaataatacacgaaattattgcctgctgttaaaagcctgtatgttttcttatctggataaagaggtaagtgtcacttgtggttttaaaaaaatgtttttctcttgtattttaaaaaatgctttcttacatccttagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggtaaatctgaaacaaaacagtcacttctcttgtcaggttcacgcttgatactccagtttctaaagtgatgaattttttcagctatagagatttttaggtatcagctgtattagtaacttcactcttacctgtaaatagccggaatgtgtatgcattgactccagttcttggtgcctgtatattattcacatgttaatttctgggcaaatcctgaattacatcctgatttcctccagctacaaaatactctgcattatcagtttttccttaaatacagtaaaatcttgagtgacaaagacaggggagtgggggcataaacaaaaagtaaaaatgcagtgaaagctgtcctgtctgtgagggatgtcgatgaagctccgtcatctgcaatgtgcagtcacatcatcatgacgcagcacagcgagccagccaggagctcctgaggcctctccctgctgtccagatctttcagcctttgatgctctttggggctgattggcttaagtattgatggggacagttctgtggctggctggaacttctgtgatggtggctaatttctggaatgataaccctggtctcatctgtcacctccctgcttcctgtgtcaggggcacctgccatttccccatctagcctggcctgccttgctgttacatttgtccctctattcccagagcagatgagcctggggctgggcataagaaagagttacttgccaatcactttgcatctgaatttgttcacaggcatggtaatttaagaattaatttagctttgtaaggaaagtcactttcacatcaaagccttttcaaaccatactggaatgttttgagattacctattttgtattgcgtgtgctaccattttgctccaagggcctggctctggaaacagcccagaaggcccctcctgacctgagcatggaagtacctcgtgaggtattggcatcccctgggagcgtggtgccgccactccatgcagggcctctttgctgactggagaaaggacctcaaggcacagccatctgtaagaacaccattgaaacatattaaatttgttagaattagattctttagagccttttgccagaaaatctttataataagtgtaccacgtctataatattgccaaggtcagtacccctgaatcacccccatgcatagctctgcctgaaaagagcatgtgaattaaatgatggtgtttttatctttcagcagtgatttttttctttattattatttctttttattttcagtgatttttgtaccagcactaattgcccctgttagcactcagtttcggaagcattgaaaagctggagactgctggggaagaaccattagaatttgcaggaatgaaagcttgcttcttgtgtgtgtgttttccggcttcggtcccaggatgactggaagcagaaacagttgggaacgctggctctattccctcttcgcatttgatcaaagccagtgttggctgggctggcataacaaatctcatagtaaatttaggaccaagagtccctaccaacaggatgtcagttgttgtgcatatgtttttttcttcattctcttattcttggatcattggttgactgacttaagtgagtcaagtattttttttttaaccttgttattagcccagaaggttcttccgtaatgatccacttaccgtgtggattgcattatcaaagtaccgtctttcttttcacagtctagttatggctcctccaagcagcagatcatagtttttccttggtgattgatcttccatgtctctatttacccagccttctctgcaaaacaaaatgaagaatggtattatctaactcgtgtttagtttcatagtccttatatccctttacaaactttttcactccgctagtcatttaaaatgtaccccctcatacctttcttttcttttttttttgagacagagtctccctctgtcacccaggctggagtgcagtggctcaatctcggctcactgcaacctccatctcccaggttcaagtgcttctcctgcctcagccctcagcctccctagtagctgggattatgggtgtgcaccaccatgcttggctaatttttgtatttttagtagagatggggtttcggcatgttgaccaggctggtttcaaaactgctgatctcaagtgatccgctcgcctctgcctcccaaagtgctgggattacaggcatgagccaccgtgcccggcctatttcttgagtttctttctttttctgcttcttgtagtgccacccctgccctgccacctagttttatgttctccatatgttagtttgcagaaggaaattaatctagtgaccagctgcttctctgtgtccaagggcctaagggaacttgttagaatgctggcttacttgtctgtctggtgagtccacagaacttggggtgtgtgtaatttcacctttttatttgtcctgtagagtccaacagctgagaaagatgtctgctggtgtcttgcctgtcccttctgccctcaggttttatgtattatgcagaagccacagggagaacatgagaattcctagaagttctagtaacagaatggtctgtcagttatagattatttccttcagggcttagaggcaggtaggtagcccaaggcattttgagcttttgaaattcatagttatttgacgtggacaagggtgggttgggaacagtgtcatatccaaccttacactgaagaaaggatgccatggattggacagaaagatgtcacttaaaattatgaaatgattaagtctgttaccagtgaggagaaatctcctcctgtatctaagaacagttcttgtacatggtatggtttttagctgaaggaacaatcactttgcgattttggatgcatggcccagttgtttctccagcaatgagatgccatgagcatggcagagagcagtaagacgctatgcagcctttaggtttgggtctgggagtcctttttaaaaaatgggagaggggagttaggaaatgcctcatagcttttaaagaagatcctgggatcgtatgggctcctgtatcccagctagaaccagtgactgggtgctgaacgggctgggtgccacagcatgccctcaagccagtgagaggagttagggctgccactgtgcttatatgcccttttcaggtttttttgttcatttgtgtttttgagacggagtcttgttctgttgcccagagcaagtggagtgcagtggtacgatcttagctcactgcagcctccatctcccgagctcttgattctcgtgcctcagcctcccaagtagctgggactacaggtgtgcgccaccacgcacggccaatatttcttttcagtagataggttttgcctttttggccaggctggtctcgaattcctgacatcaagtgatccacctgcctcagcctcccaaagtgctgggattacaggcgtgagccactgtgccgggccgttttcaggcacttaaatttaatcctggtgaagtaggtattatcactatgtgtcttctgcacatgaagaaactgaaactcaaaaacactgataacttctttgcacatattggggtttgaggccaagacgtctggctggagaggccacacgcttgccctgcccttaagaacatggtgggctgggcgtgggggcccacacatgtaatcccagcactttgggaggccgaggcaggcagatcacgaggtcaggagttcgagaccagcccggccaacatggtgaaaccccgtctctactgaaggtacaaaaattagctgggcgtggaggcaggtgcctgtagttgcggctacttgagaggctgaggcagaggaatcgcttgacccaggaggcggaggttgcagcgagccgagatagcgccactgcactccagcctgggagacagagtgagacctgtctcccctccaaaaaaaaaaaaaagaactcggtgtttgctctgcaggtttgctggctaccttctcttttcagtacactggaaatagcagcttgtgttgtttacctactctttgatccttttttttttttttttcctcttggcctcaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagca

SEQ ID NO: 1264 - DNA, 125028 bp, Homo sapiens
ggaactttaaaactgccgtcttctgctttattgacaggtaaattgttcaaaaatgttctcacaattcaataattaattacaaagactgagacttacattaaaaaagtaaaaaccagaaccccccaggtgcccatccagcagaaggcccaggagggcagtggggtggcagggctaggcggtgctgggccactcagtgccgacttggggaagtgcacgtcctgaacagccttgccaagcagccgaccggtgggaggacaggggaagcctggcccaagctgtggacaagctgtgtctgccgccacagttaatcacaagcctctgacgacacagggccacagagctggtcactcaacatctggtacaaagggtgaggtgaaatccacgcgcaggggattgctgtgccgtgggccggggccagtgtgcaggagtgtgttgggtgggtctacgtgatcatacgggctactaatcacgggggctccatgcgggggcaggactggtgggggggggggcgggcagggcggggcggggtggggtatcccagtggctgcttcgtggcgccctggggctctgacttccctcagcccagcaggccacagggcctgcctgcaccacgacactcgctggttttatggcaggaggcagaagccgtggaagcgaatggaaaacagcacagctgacttcacagtagtagatactggtgacacttcatggctgcgacccagaatgaacttaatgcacacagggacgcagggtgtcactggtcctgggcctttgtccatgactaggtggtcagcaggacttctgcagctgactgtgcaatggctaaatgaaaaaaaggccacagactaacctccactttcctgtcttcaaaattctagtgacactgggaatgctataggacctcctactattctcttaaggtcctaggaaagtttcaggaactagggaaaagactgggtactgaggctgtgtccccagatgtctgcttccgaagcagccgcgtcatgacgggtttctgctgaggaagtggtgttggcagggccccatatgccctctcgggttgtcaggggtgggagacaggctgtatgggggtccttcatgtgcagatggaacagcatcgcctcacagctgtgcagacgaacagatgtggtctactgccacgaacaatgcggcataaaactgatcaatattataataaagatttgtcttcttcatctccatatctacaaagtgattctacatttccttggacaacactggagggcccgctcagtcttggcactgacgctggaggccatctccagctccctggcccctgtggcgagctggcggcttcaggtgtcacaggccggctgctccaggccttcgagggggagctggctcctgtggggggagttggggctcggtgggccgctggggttggagctattcgatggagttgagtgtttggtggagtccgaatcaggctgtgaacaggaagagggcagggtgagcacccgctgccctagcctggggaggcacgcgtgcccagctggatgcaaatgtttgctcagggacaactgtcgcaactgctcttctcccttcatgttatgaaaacacacacgctctacaccagcgattcgtggggcccttaggcgtgctggtgagagtcacaaattgatgtctaatcccactcaaaaataacatggtaattatcattacaaaagacagcaactctgtagtgaagaaatcagatggggccggacgcagtggctcctgcctgtaatcccagcactttgggaggccaaggtgggtggatcacacttgaggtcaggagtttgagaccagcctggccaatgtggtaacaccccatctctactgaaaacacaaaaatcaggccgggcgtggtggcttacgcctgtaatcccagcactttgggaggccaaggcaggcggatcacaaagtcaggagattgggaccatcctggctaacatggtgaaaccccgtctctactaaaaatacaaaaaattagccgggcgtggcagcatgcacctgtagtcccaactgctggggaggctgaggcaggagaatggcgtgaacccgggaggcggagcttgcagtgagccgagactgcaccactgcactccagcctgggcgacagagcgagactccgtcacaaaacaaaacaaaacaaaaaaaacaaaaatcagccgggcacagtggtgcgcacctgcaaccaagcagtcaaagtcacaaacgcgacactctttcctgagaaaagcactaggaatagaggggaacctcctcaacaaaataaaacagctaaccatacccaatggtgagagacaaaattttcccctaagatcagccacgggccgggtgcggtggctcacacctgtaatcccagcactttgggaggccaaggtgggcagatcatgaggtcaggagattgagaccatcctaacacagtgaaaccctgtctctgctaaaaatacaaaaaaaaattagcctggcatggtggtgggcacctgtagtcccagctactcgggaggctgaggcaggagaatggcgtgaacccaggaggcggagcttgcagtgagccgagatcgcatcactgcattccagcctgggctacatgtagagtgagactctgtctcaaaaaaaaaaaaaaaagaaaaaaagaaaaaagatcagcaacaaggcaaggatgcctgctttcaccactgctattcaacatggggctagaggttctaggcagagcgatcagggaagaaacagaaatgaaaaggattccaagttaggaaggaagtaaagctatctctctttgcagatgacatgattatacacgtagaaaatcccaaagaaaagaatccacaaaaaactaataagctcagcaaagttatagggtataagatcaacacacacaagtcagttgtgtttctatacaccagaaatgaacacactgaaaaggaaactgaaaaaaaaaattcaatttacaacagcatccaaaagaatagctaggaatagtttaaccagagaagggaaaaatgtgtacactataaattacaaaacattgctgaaaaaatagcttaaataaatggaacacatctcatgttcgtggagtaaaaatattgttaagatggctgtactaggccgggtatagtgcctcacgcctgtaatcccagcactttgggaggccaaggcgggcagatcacttgaggtcaggagtttgagaccagtctggccaacatggtgaaaccccgcctctactaaaaatacaaaaatcagccaggtatggtggcgggcacctgtagtcccagctacttgggagtctgaggcatgagaatcacttgatcccaggaaacaaaggttgcagtgagccaagatcgtgccactgcactctgtctcaaaaaaaaaaaaaaaaaaaagacattaattatgaggaatgtaaataacgacaacccatagaacaagagaagacatctgcacatcacatctctcacaagagcctggtactcagaacatgccaggagctcctacaacccagccacaaaaggacaaaccacccatttcaaaaatgggtaaaggccttgagtagacatttctctaaagaaggtacggaaatggccaacaagcatatgaaaagatgctaaacataagtctttagagaatgcaaatcaaaaccacaatcaggtactacttcatagccaccaggacgactattaaaaagaagaaaaacaagaacaagtattggtgaggatgtcgagatatgagaaccctcacattgctggtggaatatagaatggtacaactgctgcagaaaacaatttggtggttcctcaaaaagttaaacatagaattaccacataaatccagcaatcccactcacaggcataaacccgaatgtgaaaacaggcactcaaacacatatgtgcacacacgtgttcacagcagcaccactcacaacagctgaaggacagaaacagcccaaatgtgcctcaggggaagaatgggaaaacaaaccgtggtctagccatacaagagaatattatttagcaatagaaacgccagcactgatgcatgctacacaacgggggtgagccacaaaacagtatgccaggtgagagctaggcacaaaaggtcaaacacactgccatacgagaggctgggcattccatttccacgaaatgtccagacagggaaatcacaggaaactactggctgcccaggtgctgaggggagggagggacggggagagagtgcttaaagggcagggggtttattttgaaatgatgaaaatgtcttttttattatgttttagagacaagatctcactacactgcccaggctggccttgaactcctcaggccatccttccacctcagcttcactagtagctggtactacacacgtgaaccgtggtgcccagctagagtggaaatgtttctgaatgagaaagaggtggtgactgcatctctgtggatgtaccaaatgtcactgagtagtttaaagtaactttaaagtagttattttgggcccggtgtgctggctcacgcctgtaatctgagcactttgggaggccaaggtaggaggacagcttgagcccaggagttgggagaccagcctgggcaacaaagtgagaccctgcctctatattattatgaaaataaaaaaaacaaaaaaattgttgttttgtgaatttcacttaaatttaaaagaacaaacaaggtcatgcagacgagacaggcactggctgcctcaggacacagtaccctaagagggacaccatgtcctctgtataatgtgacagcctaagacacacttcaaatcccatgaccaggaaacagcggacaaactcaaactcaggagcgttctgtaaagtaacagcagtgcttgctacaaaaatgtgactgtcccaccagacaaagacaggctgggggcctgctgcagaataaagggtggaacagtaggatggacaaaggatggagaagacaaaggacttccagaggaagagacgctgaccttggcagaaccagcaacatgtgcaaggcatctgcccgtccgttcggcagctgatgttaaaacatctcagtgctggggctgagatgtgtggtggagagatgagcatggcccctccgcctgcatccctccctccctccctccaaggatggcgccgggggctaagccctcagctcactcctcagccctcagcactgcagctcctcgcctccctcgactgcattctcatccccattccgcacaggggaaactgaggccagagcagtgtggctgagctgcgcacaacagtggcgcttgtcctggaggtggtccccacactctgacaccaagcgccatcccaagggaggggcagacagaccaaccaatgtggaaggtcagcccagaccaaagagactgctgatgtatcacattgaagtacataaaacaacacagggagtccagaggaaagaggcaggttggcgggaaagcttccattcctcctggggcagtgtgacagccctgtccctagtcagcgttcccaaaggagcttggggtctgaccaagagattgctgcacgagcctcctgggggaggggacagccaccccgacccctgcccccgtcaccctcacaccgcaagtggggtgctccaaaagggctgtgacaccacccagggccccagatcttcgggctgcttttcctcctgcagtggtggctcatagcctcagcactggacctgggcaagtctcacctctttgtcaaagtcctggtctggatcagacatacttctcagaggcacagtcacgctaggctccgatccacctacagaacaaggacagctttcctcttagggagaaagtcaagaacggaatcaaatgcctggggtctccccattccagcaccccctaccccccacctcccccagggctgcgggggccaggcttcccctgtacctgatgagggccacgagatgtagggcttgttcctggatggaggctggcgagccaggttggtgggagcggggcccggcctttcctcctgggaggggggcacagcactctgggcagaaatagcaacacgtgagcatgcttggttgacacccggcagggccggctgcgaagtttgtgcaacctacggtggctgtggcctcgtgaccttgatgagcaaaatgggggccaagagggctctctggattggacaagggttctggacagtctggaactaagaactggcaatagcaacttcagggcaggtcaaatcctataaaaagcgtactttttttgtttgtttgtttgagactgagtcttgctctgtcccccaggctggagtgcaatgacgtgatctcggctcactgcaacctctgcctcctgggttcaagcaattctcctgcctcagcctcctgagtaggtgggattacagatgcccaccatcacacccagcttatttttgtagtttagtagagacagggtttctccatgttggccaggctggtctcaaactcctgacctcaggtgatccactcactgtggcctcccaaagtgctggaattaagaggcatgagccaccacacccagcctaaaatacataattttttttttttttgagacggagtcttgctctgtcacccaggctggagtgcagtggtgcaatctcggctcactgcaagctccgcctcccgggttcatgccattctcctgcctcagcctccccagtagctgggactacaggcacctgccgccacacccagctaatttctttttgtatttttagtagagacagggtttcaccgtgttagccaggatggtctcgatctcctgacctcgtgatccgcccgcctcggcctcccaaagtgctgggattacaggcatgagccaccacgcccagccaaaaacatacttcttaagtaaaaaagagaaagtatgctatctgttggtacgaaggtgttactgagaaatcaccacctcatggcaaacgtccttaggaagccctcacaggccgaaacgtggtggactctcacaagtacctgcagcatcactgcccagggcggcccgaggcctgtgcacaaggccttgtgacagggtaagtgctcgtgaacagagcttcagcggagacgggcttgtgtgacaggagcgccaggtcagagcacagcgccagcctcgcaggcactgcctttgggacagtctcagccagcatggctgcctgagcggggaggaggagatggggtgccctgcccgccctatcccggccgtgcacgcaccagaggcaggtccatgagcacctgcatgccgtcgcctgggcccatgtgggccacgtggttgaagttggttgggttggatatcattttggatctcaattctgggtctctaagcatctctctggggaaaggacacacttttgagattcatggatacgtgagaatcctcttggccccctccctagagcgaggcccagcaggccccgtgaggccccgctcctaccgcctctgctgcagtctctcttcctctgggaccttgaagacgaaccgccttttgctcctggtgcgcagcatctgcttcttgctgttgtcggaggtgtccggcacgttgagaaccgctcctgcagaagcagagcgcgcggtgacggtgctgcggcaccagggacacacgcccctccaacttcccttccctccactcccggtgcagaggaaggctcacccgagaacttgctcttgaagtagatcaagcgtggaggctcgcagttgaggaggttgagggtgccttcagagttcaggggccttatctggattggaaaccagggagggacagtaagcgcggccacgcacagactgcaccgggagaagcccgcccgcacaggagggcaccgaggccgccttaccctccgcaggccgatggtctgcacccactccatggtgcgcacatcaaagacgtccacgccatactcgctgtacaccgtgacgtgggtggggctgcaacctagcgcagacggagcagggcggggtgagccacagtggctcaggaactcacctgccctcgggccggaggccaagccttggcacttgaacaagtgcagaggcggcagcactgccctcagctggttcacgtcaccaaagacttcatgttcccactctggaattcatcttcatttcaaagtttaaacaaacacaatccaatgtttaaatgctccacaatcacttccgtaactaatattttgaatactacagtacagatgttgaaggtgacttttaaaaagtctggtttttcatttagctctcatgagatgtgattatcctgaaagctactaattcaggctcaacactttggaaattcaggtaggggccgactgttcagtatggtgaggctaattcttccgtaggagatggcaagtccggtttccaggtaggtattaaaaaccacacagaaaccactgctgacctctgggcaacaaccctgcctgtctgccctccacactaatgaccctagacccctaggaacccgtgctatgggggcgtgggaagcccctctgcagcccggtctgagggcatatgcaagcgaggctaagggcgtcctgcagggagctctggggtccgcgctgtgctcctcacctgctcatctgttggcttacagaagcaactccacccaaggtgccacggatgtgaaaccaaggactgcaaagcctttggccatttggagtttaaggggctttctccacgtttagaagagcagtgacacagctgtgccacacgacaagggagcggtgtgcgtcttccgctcagtccctctgtgtgggtggcacgctcactgcccccacagcccctcagcgtagcttggctcctggccatcagcttgcagaaacgcagagctgggaggcggcaagccccaaatgcaagagagctccagctcagtgctccttcctggctcttctgcctccggagttcaaggttaatcctgcatcaggacacacctcactgtctgaagatgcattttaaaagccttctgctctgtttctatcacagactccaaacaggctacaagatcaggacttttcttctgaatacaaaaagggaaatcaaacagggtttgcaagaaagacaaaagatactggcctggtcaccaaactgtctcagaaggagcatttcagatgcacctgtgaggcctctgagaaccaagtcaaaagcagccccagacactgcccttcagggaaccactctccacacgggcttctgggaaggcccttgcctgccgagtatgtggggattcgcttgcaaggaagcaggaagaagtctagtttgctgactcagtgataaacagatgcccagtgaaaagattctagtgaaacagattctagtgaaaagaacatgggctctggagcctgacagatgtgacatgtgactgatacagagcacgcggcccctgtggccttcagctgcctcctctccaacagggctgataacacctgccctaagggatggggaggggcaggggaggccacccacacagggcactagcaaagggtgcagaatgagcagttctgcatcctacaggtgatggaattacttttgaccagctctgaaactcatctgcatctgcactgtgcccgcaggagagaagacccaccaaggcggagaaccgaggaacttcaggtgtctacgccagacacgtgtggccaagattataaatacattgcactaagtgacctgggccctcttcaacgttacgctttgcaaaaatgtaaatcctgtgtggttttaaaccctgtgctggctgcctatgaagaggacagggtgttggggggtaagagtccaggacaaggggtgctgaggcagcgggactggccccttcctgcacctcaccgcaggcccacggcccagccccactgcccacacatgtctgctgtggtgtggccatcgggatggagccgggacacactgcagtaagcccgtgggtggagctggccgtgcacctcacaggcctggtgtctagccacgacgccctgggtatgatgccgtctcagcaaggctgacaatggggcagacaaaggggtttagcttcaggtaactgagggagaatgtcattccccaactcttggcctgttacccccatatgcgcggctcgtcttcctcccggcctcctcttgatctgtggatttgatggtgcaggccactctgatagatcagagggattctgaggtttaaggtttcctttctgttttaaaagacagggtctcactctgtctcccaggctagagtgtagtggtgtgatcatggctcactgcagcctccatcttctgggctcaagcaatcctcctgtctcagcctcccaagtagctgggactacaggcatgtggcaccgtgcctggctagtttgtttgtttgagacggagtcctgctctgttgcccaggctagagtgcagtggcgcgatcttggatcactacaacctctgcgtcccgggttcaagcaatcctcctgtctcagcctcctgagtagctgggactacaggcatgtggcaccgtgcctggctagtttgtttgtttgtttaagacggagtctcgctctgttgtccaggctagagtgcagtggtgcgatctcagctcactgcaacctctgtgtcctgggttcaagcgattctcctgcctcagcctcctgagtagctgggactacaggcgcccgccaccacgcccggctaatttttttttgtatttttagtagagatggggtttcaccctattagccaggatggtctcgatctcctaacctcgtgatccgccctgccttgggctcccaaagtgctgggattacaggtgtgagccatattttgttatttagtagagatgaggctggtattgaacttctgagctcaagtgagcctcctgcctcagtctcgcacagtgctgggattacaggtgtgagccaccgctctccacccggtttaaggttttaaaagcaatcggacagcgggccagtcgggaagtgtccactggtcctacctgttccccagtgccaccattcatagagaaagtcatgccaactaggcgaattcagtgacccaactgtttgaaaaacagcccctaccactttcagaaaatacttgtccttagagggactgtaacttaagacaccagaggtgaattattttctggccaccaaaacccctcaagcttgtctttactactgtgtaagtttctgtattatcacgaggaaggccttttaaatgagagatgaatgccacgccccgttctcggttcgccgagcccttctgcccaggggcctatgcccgccgacggggtcctctgctgaggcctctggaagaaccggccccatgtgctcagggagagaggttgctgagcccgcctactgctggtctgagacgtgagatctgaaccatgctctctgctgcgggctggcatggggcccacctctcccgatgctctgtgactactcaactaagggactggaagacaaaccaaagcaaaatcgaacacatgctgactgtcggtgggaaaagcagcaacagggatatgcaacagaaaacatatacatactacaggcgacaggagccgcaggccacatgagctcctgcgcgcgtgccctccggccttgcgggtccacgtacagtcccatgtggctgaagcaaagcaggtactcctcgctttcgagctccacagcacaaagggcatcaaaagactgttgtgagaggaacgcaagcgaggggtcattgggatttaccaggtttagaggctgcccgtccccctggatgctcagcaggcagaacccagaagggtagcccacacagagcctgtccctgagcaccgccaggcactgcacgctgccgggagccacaatctcattgaactttctgtggaatggcttcgttctctggatctcatagcaaaggatcagccgtttcacggccacaaacaggcaggtgccagagttcctcttgagtgtggccgtggccatgagctggcagcctttggtttccggaagcttgatgtcaaagctgccttccgctccatcaagggacgaccacggatagaggtgcacatggtggttccggccacagaggaggattacgatcttctccctgggagcaagctcgatctggtgtaccttcttacagtcagcggcacggacgatcactgtggcaaggaggacaagagcgtgaggccgacgggacagccagcagctcccaggggctgacggccttggctaaagacttgcctggaacactctggggccctcccctgggctcccttcctgtgtgcacagcctgagcccggccctgagcccgtctctgcccacagagccagtggcttgaacgccccccggagaagctgccccacatccacagcgcgctcctggggcagcctcgggggctggtccaaaggctcctctgcctctgctgctgtgcacacccctcagtgcaccagggctccagctgggcagcgcttccacctgggtcctcgcgcagcaaggccctggggtgatctgggcctccttccagctcatccccgaaccagagggccctcacgctgcacatgagggacaaagagctgtccccaacccactgggaccctgagacaaatcctctgaagacgctgccctcacagggcccccagtgaagacactgccctcacactcacacggcccccagtgaagacgccgccctcacacggcccccaggctaacccaagcccctcgcttgctcagatctccccacagagctgccagggtacggcctcgcccagcggctgccccgcccttctcgctccacggccatcacatgcagagatgctgggtctgtcgggaaaggactatggctcacatgaaatgtcgctggattccttgagggatgctcccctgggcccctgccccctgcccatggccagttccagtctcctgacgtttctgctcctagacccagggctgtggagcgggtgcatgccaggatacctttgcccttcctcgctgggaagactgaagtgtcaaaattggaagcaaagaaactaaagcttctcaagtgaagcctcagcacatgtgggaaagctgcagctgttcctcctcccagggggctttccttgaccccccacccactcccgctcagtgctccccttgaagaactcgatggatgtgatacgcaacttagcaccgcgtcgccatgcactcgatgccggtcttcacggcacgctggcccctccggcgccttcatcaagcgcatttgtcttaacccttaggagctactgaccctgtgctgtctgcagaggccaggctgggcctgtgacatcccaggctggaaacgccctgctcactcaccatctcgggtgacctctatgacatagagcccttcttctaggccgactgcaatcctgtctgcatctgtggaggggtaagtaacatacacaaagtcagtacagccgaccgtgaacaatatgggtttgaatgcgtgggtgggctcattcacagatacttttcaaccatatgtggatgagaatacagcattccagggatgtgacacttcagtatcgggggtgactttctctctacacgaactccacagggccggctgactgtgggattgagtctgcaaggatttgggtgtgtgtggggctcctggagctgaccctcaggcttagccggggccaactgtactgtccgcacaggtcatctgctttttttttgagacggagtctcggtctgtcgcccaggctggagtgcagtggtgtgatctcggctcactgtaagctctgcctcctgggttcatgctgttctcccgcctcagtctcccaagtagctgggactacaggtgcccgccaccacgcccagctatattttatttttatttttatttttttttttagcagagacagggtttcaccgtgttagccaggatggtctcaacctcctgaccttgtgatccgcccgccttggcctcccagagtgctgggattacaggcgtgagccaccgcacccggcctcgtctgcttcttaacatgcatggagaaactgtctacaaacccaaatggacctgtgaccttcatctgattttcagatgggcactgcagcgccgccggaagtgctgttgcttcagacacctgaaggacacaacctttgggacgtacccacgatggcagctgtcaggatggccttgatgagaggcagcgagctgtcgtaggcttccaagggaacatgcacgacctgattcctcagccggtttttatgaaggatggactggagtccttctagaatcccaacccacttcctcttttcattctcattttctgtcagaatgagcagcgagctggtcttagaaggtgcacctaagagagaggccgtcaccttcatgacaggaaacagaagagaagagagaagtcatcaaacgccaaagccgcacgcagctaccacggccctgctggagccacgcaccccaggagcaacgggggctgatgtgcttcccaggcagggacccctgactccacctcgctgggcgccttgcagaggctcccgcggcaggacacggaaggggcggggttctaaacagccccgtgagatcgcttcctggtcccattttcgttaattctgcttttgtcaaaactacgagtagctgcctactttaaatctgctttcttgaataatcattataaaagtagattctgaaaatgtgtccaggaaaagcagatctcaaaaacactggcccaaatcatgcctccctgtgagcagcctctgagcacgcatgctaccaaatgaccatcgttccagtaacaatgatggtaatttcctgtactgtgtatgacagggttgtttctgaatagagctgtgatttagtaaaagctaatttatagacttagttttgttatcaaaattttgctgtttataagaaaattcccagtggagggggctggagggtttctttccccaattcagtcttctaggaacgtcctaatgctacaatgtctaacactaactcagtgagggagcactcactcagtcaacaaaaacgctggctccaattggctggggggcactggagaggcaccttcatgcctaacctgccacagcgcccgcctggcagtgcacacgctgtgaggacagtggccgggacgtggactgagtggaagaggagtttcagatgtaggagaagggagggtcagtgaagaggggtgtctgggaagaagccagccaggaggctccccgagacgggcacaggctgctacttggccaggacgggacgcacaaggacctggagccaggctggaggttgagaccctagggccacactggaggtgcgctgatggctgccgcagcacaatgacatgcctagaacaatcagttttaaccatgtgctttgttaaaaagattaatgaaaaattcataccctgaatatacatggaatatctcggcgtgtagcatgaatgacatctgaggccaggactgagctcacggaaaactcgtcatctctggtaaggaagaaacattgaccccgctgggagacacgcgcacaggacccaaggccctcccacgccctgccctgccctgccctgccatgtccttccaccaccgtgttctgcagtggagggcgggtccctcgcctccccagatgtaagaaacacgggcagggccaacaaactcaagactctggcaggtgtttcagggcttagggatgccgcaagggaaaccccggagcctcatccccactgtgctggtgcctccagactatgccagttacagaagactcggtttgcacttggcacagccaggcagtccctccaacagccaagtgcagaggacaagtggggtgaggggtgtggaagtgaggggggagtgggagggagtggggggtggtggggggtgggcgtggaggtgacaggggagtggggggtgggtgtggaggtggaggggagtcgggggtggggtgggggtggaggtgagggggaagtaggggggtgggtgtggaggtgagacggggagtaggggggtggggtgggtttggaggtgaggggggtggggggtaggtgtggaggtgaggggggagggtggggtgggtggagaggtgacggggagggtggggtgggtgtggaggtgaggggagggtggggggtgggtttggagggaggtgagggggagtggggggtgggcttggaagtgagggggagtggtgggtgtggaggtgagagggagtggggtgggtgtagagatgagggggagtgggggctaggtgtggagatgagggggtggggtgggtgcggaggtggggtgggtgcagaggtgggggggtggctgtggagagggggagtggggggtgggtttggaggtgggggggtgagggagtgggggtgggtgtggaggtgaggggggagcagggggtgggtgtggaggtgagagggggagcggggtgtgggatcagtgtggaaatgctgttctgaagaggttccctaaagagtgctgagccctccgatggggcccctgacttgggctcatgccaacttttcgtctaccagtggcccttcaccaccaggccaggggcacacctgtgcacagccagggactggcgggtgccccgggggaagggacatggaaagtggagtatgctgccaggtgatgccgactcaccctcgctgtcctcagggtacccacccagcagccctgcccccaagaaccaatgctacagatggagtacccagccccggcctgagcccagagcagtcccgtgtgcaccacacaacagacggtgcacgggcacagcacagagatgacacaaaggcagtagcatggctccgtgtgcaggccccgggctgagctaggcctcttagtgatgcgtttaccttcacaacaacattccacatgccagtaacatgaccactgtcctcttctcactaacagatgagccacagatgtcaactctaagaggaagtgggaaggaggccccgcctgctcctgcagctgacactgggtggcactgagacagggtcacatagcaaacgctacggccacgcacacccacatggcccacggctccagacttcttccacacaccagcacctgctgcggtctctaaaacgcacagacggctgtgggccgcgtggcttttctctgggatatcttctgcttgttcttgggcatgtggttttcttatgttaaattaattcccctgtggcaaacttctcaacgcaaacacatgcgaggcaggaagcgtctacagcgctcccgttcctgcgcacgcaggcccgtatgcatgtctgttcatacgcatgtgagcgcctgaagtcatgactaagctgtacccatttttgcaaccatacaataatgaagcaggtgaagtactaatgaggtgaaagactactaaggaacacaccgtccttttggctaaagatagctgaggaagattcacagagcaaggacagtgctgcccaaacgcagacctgagatccaagacttggctcgcaatgacaccaggctgggtggattttccttcaggcagatcatacaggaagagcttgcagtcacagacgactgcatatgcgcgctgccatcccttcttcacccccgtgggctttgggacctatgaataaaaacaaacagtggccacgttccaccaggccaggcaggccgccaggccccattacactcgttcacaatctccttccagctgccaggctggcggcagagctgtttggacagagggatgtttgcccaagaaggctcaaggcgttgctggggaggggtccatgcgtggcagcagacggtgccagggaaagctggcagctcagccaacgctgtgtccaccccatgcagggtgctgtggtacacgcagcccgacagtctcgtagaggtgggcctggcacagtggctttcagactgagcttctgcccactggctggacactcagcccaggatggactctgagtgagcgtctgcgtggaggcctcaggatgcccaggccattcagaacagcggctgcgccgacctgatggcctcagtgcccaggagggtaagccccctaggactggcaccagggccacctgccgcagcaaggggctgctttcaagagtggctgggcatggctattggtcactgcacctcacaggcaccgagggctgagggcggagatgaagccgcctaccttgacatggcctttgtaggctgttccgatgcctcgctgcacgtccacgcccagaggcctcttggactgctcgggaggtattgggcacacctggggggcaccgtctttgcaggacacgtggcaagcaaaggaacacactggaagagagcaagaacactgccttcaaagcttgctgcctacagagaagtcactgcagaacctatgccctgaggaggcaatttaataatcaccaggtctcgcctggaatcccagcactttcggaggccgaggtgggcagaccacttgaggtcagcagtttgagaccagcctggccaacatggtgaaatcccgcctttattaaaaatacaaaaattagccaggggtggtgaagcgcacctgtaatcccagctactcgggaggctgaggcagaagaatcgcttgagcccgggaggcggaggttgcagtgagctgagaccacactattgcactccagcctgggccacagagcgagactccatctcaaaaaaacaaaataaaacaaaacaaacaaaaaataatgatcaagtctcacatcaagtccagacacccaaaaaggtaagaacagttgcaaggcagaatccacacaaaagctcagggtttctggcatgaatgcgtcttcagcatgcgcacagggaaagggcccatggcagaagcctgcttccatgctgtccctgccagcccgggccgcctcccacacgtgggagtttctacacggcaattcaggccagcggtcatggggacgtggggtcttggcagccaatcaaaatgtgcatgagttgaaataacaaaaaacaatgcttctgctataatgtagaatgaagggcatctctgttcacagacccatggtcaggaaggcgtgagtgctcagagccagtgcgagtctgggctccaggaccctcccacagcactgggtggcttggggtggttgctcatctgtgaaatggggcaatcactgagggggtaagagcatgtcgaatcccagcacagggcaagagcacaagatatagccttaaaaatatgatgggctgggcgcagtggctcacacctgtaatcccagcactttgggaggccgaggcaggtggatcacttgaggtcaggagttcgagaccagcctgggcaacatggcgaaaccccatctctactaagaacacaaaaattagccaggcatggtggcgtgggcctgtccccagctacttgggcggatgaggcaggagaatcacttgaatctgggaggcagcggttgcagtaagctgaaattgagccactgcactctagcctgggcaacagagtcaaactcttgtctcgaaaaagaaatagaaaaaaagaaaaaaaatacgaatgacgaccagaagcagagacaaataattgtggttatctttagataatttgacagtggaaggttttacacaattacttttcctctctgattttctagaacagctgcagatgatctacttcgtagtaattctcagtagatgagttgagtcaccacagaggcgcacagcacaatggagcccccagcacagcagggatccacggttccacagacctttactgaggatttgtaaaaataaacctgccaggctgggtgcagtggctcatgcctgtaattccagcacttcgggaggctaaggcgggagatcacttgagtcccagagtttgagaccggtctgggaaacaaagtgagatccctcaactctctacaaaaaaaatttaaaaatagccaggcatgctggtggtgtgtgtgtctgaggtctcaactacttgagaggctgagacaagggaatcgcttgagctgaactgtgattgcaccactgcactgaagtctgagtgacagagtgagaccctatctccccactccccctaaaaaaaaccctgtcctcaaatcatgccaatgacatttcactttagtttggtttgcttgcatcagggctgccctggagccggctggtgcccttagctgcaggggtgtggggctgtgcacgctgaccccaggagctgcaacgacactcaccctcgcaggcgtagccctgccggatcagcccaaccatcagggaggtgcagtggctgcactgagtagggctggagaaggacttgatgctgaactggtgagcttttggctggaaggagaaaatcaagaacactgaggtgaaccatggactcttgagagtcagatccatctgcctgtgatccagtttatacacagcttgggcattatcctgaaaaggtggaaatgtgcaagttctggtcttggtctacgtgttccctaacagggctcatcaaatagtggtgaaaaccacctacgagcctgagccagagagaggccaacaaatacttccttcagtgggagagcactgctaccaaaaagcgaggtcagctgggccagagggccgaggtggcatggccagtgctctttctggctcatgctcctggcctcctggagaccagcaccaactggctcttgggggccgacctggggccacatttaggttgggctgcacacaggccttgcatgtgtccaagagacacccaagaatcaccgacaggaggacagttcataacagcaaacgcctggaaaggctcacggtccctcatcaggagtggacacattgtgaacccagcggcaactgcagcagccccaaggctgaacagagggtcgtggtgcaggccatgcgggaccgcctgtttaccaagctcaggcgcagcagagaccaatacgatcctcagcaggaaacagatgtgggtgagaccacttgcaagaagtaggggagtgaccgacacaaactccagagagctgtgggggaagaggctggctgaggtgggcagggaggccgtggggcggtggccgggccatcaggactaggagtgacacaccagcactctgcagagttgctatcaaatatggtaaccaaataaacgacctcgcgacttggtccctgactctgcaagagtcttagtccaaaagccaaacccttaggtagcctcatagaagtttggcttcttacgtccagccggcatagctgcctgtggcaggaagcacaggcagaggccgtgtctacattaacaacaacaaaaaccaccttaggccacagggctacgtactcgcaatgcttggaactcaggggcccgtcaccctggagactttctgatctgcgttgatgtttatatgaaagaaaaggggatgttacagaagaagccgaggccaggacaggggagcaggggcccagtggggccgctgtgctggctctccaggatgcacttgtggaaaggatgaggctcagaaccgcacatgcactgcagggccgtttatgctgggagtcattctcacccaccagccacatggttctgtaaggttctctaagtgcaggcagacaaatgaaaatcaatgtggagaagtaagctgcctacctgtggagaggggaatatggcttggggaatgagagaaggagagtggggagactgaatgctgaacttttccaattaaaatatatttgtgtagcactggtatcattaagaaaacacagggtcctgacagcttcctgaattacacaccattctcaacaactttcctacagaacatgagggtcgctactgtgtgtatgcaaaaatgactaagtatgttttatttatacaaaacttattttctaaataactgagaataaataaacaactaaataactaagaaggcgccccgggtgaaagcaaggcccctaccttcggtccagccagagccagggcctgcgtggtgggcaacggcacagcggatggcctctgcgggggccgagccatgtcctgggagacaagcaggacaggtgagtgtcggcccagctcagcatggctgagacacctggccctacggggtgcacttctctcaagaatgtgttaacagtgaacagttctgcatttttaatttgctacaatgttgagacatctgcggaagcctccctcatctaggggagggactgacagttaattctcaaaatgaaaggtgggcttgagcacctgggcagaggccctcgctgcaaactgttatgcaggggccaggtgagcagcatctggtcacctggacacgagggcagaccccaggtgggagcatcaccagggcaacgctgtctcacctcctgctgctctgatgcagccacagacatcgacggggacgcttctggcttcggagcttgtgtttcttgctcactagctgagctggtctgtgagaaccaagaaagaaagagtggggtgaaaggacatattctacatgatccagactctacttacaagttctttactaataaaagcagattctgtctagcccagaagtcccagcggttcttactcctggatcctatcaccccttgggtctcctcacagacccctgctccactcccagctggccggcctgccctgaggacccctgcacttggcttcctcagctgagtggtgattgcgtgggcaggtggagtctgacaagtcacagtcaccccgctgaggtgagaatttgcctggagacacctctaatgcacagccctgagcatacccgccccctcctgcagcctccttgccccggtcactgaaagggcaagacctggaaatgctgatccttcctgacctttattcataagtaatgttatctaagcctagcagccttaagatcaattagccaggccaggcacggtggctcacgcctgtaatcccagcaatttgggaggctgaggggggcagaccacctgaagtcaggattttgagaccagcctggccaacatggcgaaaccccgtctctactaaaaatacaaaaattagccgggtgtgctagcacacacccataatcccagctactctggaggctgaggcacgacaatcgcttgaacccaggagaaggttgcagtgagccgagatcaagtcattgcactccagcctgggcaacaaatcaagactgtctcaaaagaaaaagagaaagaagaaaagatcaaatagccaaatgcttcttaacctcatttcaaggatcaagaagaaattcgaacatcaacagaggtcggtgggcccatgagtagatttaagaatttccttgaaaattttatgacacagggaagcaatgttttgttttaacaaattaagagttctaatttcacagtgatttatttgaagctaaagctacactctgaaaccacttaaaaacaactctatttcaacaagtattcctgaaactaatagtttatcatcacaggccactgctgtttacagacgcacatgtaggtatgctgagtagcaagtgttagcaccagcaagcagtgtgatgggacacagacatggctgggtaggcgcctaaagcattgacagctgtattttgtgttccacatcagaatcccaatgaaccaaatcagataaacactttccaacagttgcaattaattaggccactgaggaaggagccaaattcagatgggatggcagcatacacacataaaacacacacacaactgtgtactgcaaattcacaagggaaaggctagctcgactggctaattaccaaagctcaaaaatgtaagcaaatctgccccataaacaaggtatgttaagtgttacggttccatctttagataaatgagaaaaagaatattaattttaggcatgtaaaagccccactcgtttcatttagttggttaattaatcaaagggatgcagattcaggaacaggaacattgaggaggctgtgcactaacaggagtgaaagctgcgggaagccagcgctggcagccacttacttcttcccaaaaggctagcagggaagatgcagacgaggaggagagagagtccttggaggtaacagacaggaggaacaaacatcatttcccacccagtcaacactggcatgaagatatattgacttaatcttggtgacaaactgtttctagtaaaaaccaacatgtttcatgcaggcagcgtgggataagaagtttctcaaagacaattttcaaaagagtctggaagctctaacagacccagcccctgatggagggttttttctgttcaacaataaatgccttcccatttaaatcacagagggattagcggccaggcacggtggctcatgcctataatcccagcactttgggaggccaaggcgggcagatcacctgaggttaggagtttgagaccggtctgggcaatatagcaagaatccatctctacaaaaatttaaaaattagctgggtgcggtggcgagcacctgtagtgccagctactcaggaggctgaggcaggagaatcgcttgagcccaggagtttgaggttgcagtgagctatgatggtggcacggcactccagcctgggcagcagaaggaagccctgactctaaaaaatggttaagatggtaagttttatgttatgtgtgcttatatcacaatttataaatcaattatgggccaggcatggtggctcacacctgtaatcccagcactttgggaggctgaggtgggtggatcacctgaggtcagaagttcaagaccatcctgggcgacatggtgaaaccccatctctactaaaaatacaaaaaaaaaaaaaaaaaaaaaaaaaaattagccgggcatagtggcgcgtgcctgtagtcccagctacttgggatgctgaggcacaagaattgcttgaacctgggaggtggaggttgtggtgagccgaaactgcaccactgcactccagcctgggtgacagagtaagactgtctcaaaaaaaaaaaaaaaaaaaaaaaaagggagggatgagggattagcaagggcaggcgtgctggctgtagagaatgaggcatgaagatgccgcctctgtctccatctctgctgcccactctccacagctgtgactcacacactcatggacagtactggctgtaaactcacttgctaccgggccctctactctgttaatgttacagaaagctaccgctttcctggccgcctccattcagtgatcaagcaccatctctggttctctggaatccacttattcctccccacagcagtgcccggctccgcagcaacgagagaggcaatgacttgtgcagaaacaggcttatcaaagatctggcgggcacttaccggttaaatagatttgcttcttcaaaactgtggatttcagggaaaagacaagcattgccagtttgataaaacaaacaaacattttgacaggtgaaggtgaacaggtgtgcgtccagagtggctgtgagcaatgcaagcctgcttgggtgttgtaatgacagacacaggccaggatgctaagagtccaccccaagggaggctgctacgggcagatgcccacatgggcacctgctgactgccccctactcacacaggcagcaaccctagccaaccccacctcaacccaacgatcagacttggcatcacccaccctgggcaggccggcctctgtgcgtggaaagggcacagctcctcctgaggagagtttgtgccaaaggttcaacccacaactgatgaagatgaaacatcagacaaacccagagtggacattctgcaggacaactggcctgggtaacaccaaaatatcattgtcataaaagggaacagatggggaactgttccagattaaaggaaacaaaagactaaatgcgattcatgacctccagatggatccagaactaggaggaaaagccagcaggaaagggcattcctgggacgacaagggacacatggatatgggctgtcccacggcatcagcacagaatgcctgatgacagtgacactgtggttatgtgagagaatgccccaatcgtaggaaataactgctgaagtatgttggggtcgctgataccttcaagtcgctttcaaatacttcagaggaagaaagtctcttatgttgagagagagaaagcagatgtagcaaaaccccaggtgagggacatgtacacatgcaccctattcttcccactcgcctgcagggctggagttttctaaatcaaaggctggaaccaccttccccaccctgcaccccatcaggagttccattagtgagctccactctccctgctccaatatgctttgcgtgctgctatcaagggtgcatccctacaggtttcaaagaggaggaaaggctgtcctgcctccacggaatgccaccaagaacctgcggcccatggagggaggcagtggggtctgctcctcactcgacagctaattcccaagtagatgaccagcggctccgactgcctgagggggttggcctccttgtgagggtctcggcaaggcacctggtgccagactgttcccatcaaccacctttcccatcgatccccaatgccgaactctacagctacacagatggaaacacaactaaagtatttttattcgctctagtgtgggatttttttttttaagagatagggtctcgctatattgcccaggctcgtcttgaactcctgggctcaagtgatcctcccacttcagcctcccaaagtgctgggattacaggcgtgagccactgcacccatcccagtgtgagaatttgtattattttcttgaaataatcgctacaggctgggcgtggtggctcacgcctgtaatcccagcactctgggaggccaaggtgggtggatcacctgaggtcaggagttcgagaccagcctcgccaatatggtgaaaccctgtctctactaaaaatacaaaaattagccgggcgtggtggtgggtgcctgtagtcccagctacttgggaggctgaggcaggagaatcacttgaacccgggaggcagaagttgcagtgagccaagatcatgccactgcactccagcctgggtgacagagcaagactccgtctcaaaaaaaaaaaaaaaaatactcactacacagctgaggccagtgcagatttctccctgaagaggctgagcactttcttaatctcatctctacttaatctgagttgagaaagcttctctgggagcacctcaaataccctaaatgtctgtcacctgatgcgtttaatgtgggttgattacatgtgggtcaattacacagttagcacaacgctgagataaacactgaatgtatatttactggtgtgtttgtggccccatgagtggtaaaatcatatatgacactatttctaacttatcataaactcatctgtcacttaaaaaaaaaacaatgacttactctaaatgtcaggtcatgtgcaagaggagcagtgttgaaatactcaaaaatggaatcctgaaaatctggaagtttgagccctgcaaaaagaaacaaagaatagtcaaggcaaaaaaactaaagtctacatattattttcagacagactcagtgtcttcaagatgtcaattctccttgagtaactgatacatctgacatgatcacaattaaaaaaaaaaaaaaaaaaaaaaggggtcaggcttttccccagagagtaacaagaatcaaaaagttcacttgaaaaagtaaccaagggactgggtgcggtggctcacgcctgtaatcccaacactttgggaggccgaggtgggcggatcacctgaggtcaggagttaaagaccagcctggccaacatggtgaaatcccatctctgctaaaaatacaaaaattagctgtgcatggtggtatgtgcctgaaatcccagctactcgggaggctgaggcaggagaatctcgagcccaggaggcagaggttgtggtaagccaagatcatgccactgtactccagcctgggcgacagagcaagactctatctcaaaaaaaaacaaaaacaaaaaacaaaacccctcaaaaccacaggggcagctgggctgggcgtaggtggaggaggagcagatctaccagatattaaagcagattcactaaggcctctacaataagaatcatggccaggcacagtggttcacacctgtcatcccagcactttgggaggccaaggtcggaggactgcttgaggccatgagtttgagaccagcctgggcaacacagagagaccccatctccataaaaattaaataaataaaattagctgtgcatggtggcatgtgcctgtggtcctagctacttgggagacagagacaggaggatcacttgagctggggagattgaggctgcacgtgccactgcattcctgcctgggtgacagagtgagaccctgtcacacacacaaaaaaacacatatcaaaaaacaagaatcaagtggttcttccccatgaacaatggaacaggggagaagatccagaaacagacccaagcccatggtgatcctgtacatgacaacagtcatacataaaaccagcaggaaaaatagcttaataactggtattggacaaccagctagccattagcaaaagataaaactggatacactcctcgaaccgtatgtcagagcaaatttcaaatggatcagtattctaatttaaaaaatgaggctgggcacggtggctcacgcctgtaatcctagcactttgggagacacggcagtcagattgcttgagtccaggagttcaagaccagcctgggaaatacggcacaaccccatctctaaaaataaataaataaataaataaatagccaggtgtggtggcacgtgcctgtagtcccagctactcagggggctgaggtgggaggatcacttgagcccagaaagttgaggctgcagtgaaccctgatcgtgctactgcactccagcctgggcaacagagcaagaccctgaatcaatcaatcaatcaatcaatcaatcaatcaatcaatcatgaagccacacaagtatgagaagcatgagggaatccctccaacaactgggagttaggtgtattttcctatttatgactcaaaaaaggaagaagactgaaaacttgacacacaaaaaattttgaaaaccacctttttttttttttcttgacagacggaatctggctctgtcacccaggctggagtgcagtggcgagatctcagctcactgcaacctctgcctcccaggttcaagcgattctcctgcctcagcctcctgagtagctgggactataggcatgccccaccacgcccagctaatttttgtatttttagtagagatggcaaaaccccccccacttttttttaagacagcgttttgctcttgttgcccaagctggagtgcaatggtgcaatctcggctcaccgcaacctctgcctcccgggttgaggttcaagttcaaacaatactcctgcctcagcctcctgagtagctgggattacaggcatgcaccaccacgcccagctaattttgtatttttacaagagatggggtttctccatgttggtcaggctggtctcgaactccagacctcaggtgatccgcccacctcagcctcccgaagtgttgggattacaggcgtgagccaccgcaccggctgcaaaaccacttttatttggcaaaaaaataaataaatgataagcaaagacaaactaggaaaaatacttgcaacttacatcacaaacaaaaggcactaatccccaaaatgcaaaaggcttttagaaatccgcaagactaacaacctgaatttttaaaagcgggcaaacaataaaaacatataatgcacaaaatacaaaagtccctcaaacatataaaaagatgctcaatcttacttatgagaaatatgcaagttaaacctctacggagatgctatttctcacctattcagagcggcaaaaatccaaaagtctgaaatcctactttgtgggtaggctgtggggcagaaacccctcatgcaaagtgggaggaacgtcactgcacagcctctggaggcctgtccgtcagcatgcagcaagagtgtacaggcatgtttgccctttgccctggcaatcccacttctagaactctatcccgaaatacaccgacaaaaacaggaaatgttctatccatacagccactcctggcagcactttctgtgacagcaaatgccagggaataaaccatcccagtggctggccagcccacggcagcgcacagtgcagctgcagaggaggccggggtggcccctccagcacaaaatgatgccttttgtgttatcaggggatacaaatgtgtgcctagatttgtgtggatttgccatatgctttcaagatgaaaggaaggataggctgggcacggtggctcacacctgtaattccagcactttgggaggctgaggtgggtggattgcctgaggtcaggagttgcagaccagcctggccaacgtggcaaaaccccatctctactaaaaatacaaaaattagccaggggtggtggtggtgtgcacctgcaatcccagctacttgcgaggctgaggcgggagaatccttgaacccaggatgcagaggttgcagtgagccgagattgtgccattgcactccagcctgggtgacacagcgagactgtctcaaaaaaaaaggaaggataaaccaaaaacaatggctacctttggggaaaatatatttgaagatgttgtttgaaaatgctgattttggaaaatactgaatttggaattctgtaggtgcttctaaagtaactattaagtcgaaaagaaaataaaaacattcatttgaaaaatacttatattcaaataatgcagaatcgcacaacattaatttaccagtatctgctctgaatttttcttccatctttttcttcaaaatttccatttcttctaataattctctgtttttggcttcggaatcctttagtttgctaaaataaaaaataaatggctttaagtgcactgagaagaggttgtctgtgagctggtatggggcaggtcaggatgagagagccgggatttctccccagcactcaggactgtccagaacacggtagctcatgctgggcctttctactgcaaacaccatgaacagtacgaatatttcaaatataaacattcaaacaggaatttaaaaagtcatggcttaggaaggcgtgtctcatgaaggcctaatggagctcttgaccttcctaatcttgttcccaggcgagtcctctgttcttcagggacacagggcccaggccgctcagccgtcagccccatcaatatctttcccataactggcaagatggtggctgcaccaagaagcaccagcaccacccgcacgggtagccttgcaattccagcaacttcgtgcaggggacagaggaagtcaggctgccacggggaacacctggccgggagggatgcagtttgtgggggctggtccactcatcagtggggtgacagtgggcaaatcacctgcggagtgtgtgtaagtgggagtaacaagactgcctaccctgttgggctgtgggagggtcacaggatttaacaacagaacagtcttacagcaattcccagtataaagaaagtcaatttaactgaaacctattaccattaattttttagccccaaactaacaggatttgggacttggtaattctgttagagacactgtcccttccaggtcctcgcctgcctcatggcacagcagagctggcctggtttttatgaaactgacgttcattatcgtatcctcgtaaaaccagatctgcaaagaggagactctcagcaaatactgactgaatcactgctgtgtgaaaatggcgttctcgttactgcttggagttagggaaaaatttcaagtgagaatgccatcttcaacctctgttttaaaatattcacgttagcttgaaaggaacaatcttgaattagtgaatggagcggcacggaggtgactaagcagtgagaggggctcctgtcagacagcggtgtgagtctcgctacccagcgtgggggcacaagcacccgctgccgtcaaaacacggctcgcaccgcaccacacccccccgcggcaggcaaggccctgcaccctcgcggccacctcagtgccagaacggcctgctattcggggctcctgcaggtgaacccgacgtgctgcctcctaaggctccagcaaacgccgtggccccgattttccaggcgaggagcatcggagcccgtgaggctcagggcgggctcgaggccacacagccactgctcctacctggagtcagaccctggcaccaagtacctttccaaggtgaggttggcgtccttgaccttcctgagctcctcctggacaagctgcttggcccggatctccgcctccagggccgactgcagctccagccgcgcggacatgtccagcttctggctgcggcgcaccttccacagcgggtccttgagacacggtcatggcgttaaaaatgcattttcagttatccgcttgttaaactaatgttaacaaataagttatctttgtctaaccttaagccattacggtctcatttagatattaactctaaattatggaggtgcctcaggagttttagttttgatattttatgactttttttactcttcctcagaaatcttctaaaaaataactaaataatttactttatcttttagaagaataaaagtgattctgtagtgcaatttcttttcttttcttttctttttttttttgtttgagatgtagtttcgctcttgttgcctaggctggagtgcaatggcgtgatctcagcttaccgcgacctccgcctcttgggttcaagcgattttcctgtctcagcctctccagtagccagtagctgggattacaggtgccgcaccaccatgcctggctaatttttgtatttttagtagagacagggtttcaccacgttggccaggctagtctccaactcctgctctcgtgatccaccccccttggcctcccaaagtgctgggattacaggcatgagccgctgcgcctggcctctgtaatgcaatttctatatgggtccactggaccctggacccttttacaaacctaaggtacattatagggttcggttatctttttctcataacttgaaacgttttgctatttcaccatcctgggaattatgtcattactcattcctacctgtgattaaaaaaaaaaaaaaaaaaaaaagactaaaataataagggaagaatgacagagtgacctaggatgaagcaacagtggaataagccagttcactaacatcatcctcctgttttcttactgagttgcccaatgtatgacatcaactttcgagaggtatcaaagaagtccagagatgccatcttgctgttttttcttttttaaaacaaactgaaaacctttcattgaacacaattgagaatgcttcattttccatctataacagtaaagagaagaaaatggacagaggaaggccaggtgtgggggctcatgcctgtaatcccagcactttgggaggccgaagcgggcagatcacctgaggtcaggggtttgagaccagcctggccaacatggtggaaacccgtctctactaaaatacaaaaatgagccaggtgtagcggcacacgcctgtaatcccagctactcgggggggctgaggcaggagaatcacttgaagccgggaggcggaggttgcagtaagccgagatcacgccactgcactctagcctgggcaacagagtgagactgtcgcgggaggaaaaaaataaaatacacacatcactaaatgaaccaatgaaattaataaaagcaagctctctgagggcagaatccagtcttaacttgacaccacggagctcagtgctcagtaattatttgctaaacgaatgaatgctgtcgagagaagccatgatgatctgagagctggcaaatgttggcgttccttaaattggggaactggttacacagaagtctcttgcatcactgtaattccctaaatagtacttatatgtcacatttatacttaaaaccattagcgaattattcagtaatagaaatgcaggcattacacaaaacctaccagtgttcttgaccccagactagaactcctcaaagcctcgagctcttcggtcatcttggaagcaagagcttgaaggtaaccccgggcatctttctcgtcactgaccctggaggagggaacagatgttctatctcacgaagcatggctatcagggagaagccaaacaagaaggggacgttcccgccttcctcggcacacagtgacacagtgtcacgtcagctagagtgcccgcagtgtacccgttgtatacacgggatctcattgatggatgcgtcgttacattgcacatgactgcagtttaaaaagacaccaaacttccaagactcaagaatgaaaaaattctattactccataaatatatatacctactacgcacccacaaaaattaaaaataaaaactctttttttaattacaacttcacaccttaggagcggagggccaggtcccagctcgctccaagtctccctgctgcttctgcagccgctttgggagggctctgcctcccctgtctctgagaacgcaaggggtgtgaacggtttgccccaagtccttcagtgggttggtgggggcgtatctccacctctattccaacagaaccactgccccagacatgagaagttctggggaacagcagtgagacctgcaccccagcctgagaggcacggcctggcgtggagcacaggatcaggcagaagaggcggggcagaccccatggactgagcagggagcggattcacggccgctaatggggccgcgcacgtaccactgaatgatttccgcaatctgagcttcccagtgggccactgactccttcttggctgccagatcctgcagctcatcctccagctgtctattttgagctgtgagtttatccacaaaggaacagagctgaaatgaaacaatttcaccacagaacttgttaatcgggcatcctttaagtatgctggatttaacactggaagttcttttgaagactctgaaagttttctttaatcgtcatgagatttttccaaactaagttcatgatatggatttttttcactgtatctagcttaagtcacatttcaattcaaatctaaacctaaactgatggagctggagctagtgacttcaggcaattggcatcttttcgctgaatacaaacatcctatttaaaagaccaaacacatgactccattcaaaaattaaaacagtcacgtgtagtgaaacagcaagaacacggtctgagaaacgtgtccttgcacacacagcgtgaatgcactcacgcaagcctagacggtgcggctgccgcacaccaggccctgtggtacagcctgtcaattccaggccccaagcctgcataccatgttgctgtgcgggacgctgccggcggctgtagcacaatgctaagtatctgtgtatctcaacacagaagaggtagagtaaagtacagtattatgatcgtacgggacgcctgttgtacacacagtctatcattgatggaagcatcgttatatggcacattactgcactgtaaaaagacaccaaacttcggccggcgcagtggctcatgcctgtaatcccagcactttgggaggctgaggtgggtggatcatgaggtcaggagattgagaccatcctggctaacacggtgaaaacccgtctctactaaaaatacaaaaacttagccaggcgtggtggcagacgcctgtagtcccagccacttgggaggctgaggtgggagaatggcatgaacctgggaggcagaggttgcagtgagccaagatcgcgtcactgcactccagcctgagcgacagagcgagactccatctcaaaaaaaaaaaaccaaacttccaagactcaagaatgacgacattctactcccccataaatatatatacctactatgtacccacacaaattaaaaataatttttttttaaattacaacttccacacaaagtgctaactcaggtactttgaattaattaccttttcattttcagcagttagcttcttgttttcatcaaacagcatcgctctttctcgttcgtatttatcttttattgtacctactgcctcctccatctcgttatgcctgccaaggtgagcgagaaacagttttaaaagctcgtaacttcactgatattcgtatctatggcgtgggtatcagcttgcatcttctgaactgagaagctcatgaaaacctaccgttctcgctttgacttttctaacttatcttttaacatcaagatttctttctgcagggccagctggtggctttctgaatcatgcacctccttcttcacatttttcacttctagcacatgggaggcctcacgtctgaccaattcctcttcataaaataagactttcttctccagctcggatttgattttggaaatctcttgctggtgctctaaggtggcacccgctccccggcctccttgcttcacctgaagacaaaggttaacataaattgacaaacctctgtgtcctcaagggtcacactgtcctttcaacccctttcatcccaagcaagtgcagacaccttcccaaggactgtgtgtgcctggtctacaccagatgacgtagctgacctggctaacgtgatccaggttctagggggtcacagcaggagacggccttgcagggggatgtgcccaggtctgcctgggacccccgaagctctgccccacaccctgttcattcatgcttgcagcattcttctgagggctgactctgtgctgggccccctccttgtgactggggtgacactgaggtctctgctctcttggggctggcgggaactgacagcaaaccagtaaaggggcagaggggccgtgcaccccagccaggttgtagggagtggagggcgtgccaggatggctggggcggcttctgtaaggtgctggcctattaagtgaggtgtcaggctaggggcaaagaacaagggcacaggctggagtgaggtgggacgtgttggcagtgtttgcagcatgcagagaggccagtgtgtctggtgtggcggggcaaggaggggcaggagaggcactgctgggctggagcaggcaggagggtagctgctggacagctgcggagccacggaggccctgccgcacaggaatgtgatccggctttggtctgccaagctcactctgcctgctgtgcagagaggagactcaagggctgagaaaggggcaggagcctcgggcaccacatgccgaggtccagccaagcccgctgccagggaggaacagcatctcaggcccacgtcccagaggaagagttgccagatcactgaggcgaagggagagggcagacccatcgcacgcggctcacacatgaggagatccaggccacgccatactgccaaggagatccgcctccggccccttgcccacttggccactgtggccttccccactcccgccctccgcggcctccctgctaccctccagccccaccagtgggccccgactgatggccagcctgtctcttccccagtcagcagcaggctacgggctttaaggagcttttccaaaactcaactgcaccgaatttagaataccacgatgtgaagaaggctatgaattgatggggctggagtaggaaatgagccaattagatattcgtttcctaggacttactgtgaattgcctgaaacttttatataacaaaggaaaaacatgaacttggcctttaaaaatgaaagcagtcacgaaggcaggggtcacaccccccacctctccacatgtgggtcttgtctgaacagcctcgggtgacactcggcccggaccacacattacacaaggtgacttccatgtggtggcgtcagcaaagataagcatccctctcagttaagggcagagacccccgcccagcactaccttgagggcctccagctcgctttccatttgcttgcagaagttctcgctgtgctcacgaagcttgcgctccttggaggcctcagcaacagcatcatcaagctgagcttccagctacaaaaggaagatccagtttctattaacaaaaagcgagccctgcttcaccagttacagcagcacccacgggacctccacaagaacaagacctcgaaggagctctgcgcgtgttcacccttcatcaaatcttatcacaaattaaagtttgagaaatacacttctgggttcaactgggatggttggttactaataaaacaaggttcaattctagcttaaattgacacttaaatttcaagaaaggatacatttcttgaaatttaaatttcactgattcgtgaaaaccagtacttttgatatctgtagaacttgaattcatttattaaatgggccatttcaaacacgcacacgaagaacgagcagaatagcgaacacacgtgccggcacccagcttcaacagtgagctcccgagccaagcccgcttcatctctgcctgtgcccaaaccactcgagggcaatcccaggcactgttatcacttcccccatatgtggaatgctaattcctcattaggggtatcactaacttcagttttaactgcctgtaactacaaatatatttgggttgcaaaatagactaagaagaaaacaaacaggtcctctggggctaaagaacaaagagccctgaacttgaaaggaacaggagcatgtgcttccaggccttctcatttatgggatttatcaaggaaattttaatagagttctaaactaagcatcgcttacaatatgtcaaccattcacagcagaacactcagaacacccagggcggcacagggctgcaaaccctggggtcctgagacatcaggggtgtgcaaggcccttcctttcctaattagctatctgtgggggccaggatttcttcatgtactttatccagaacggtgtagcaaaacggattgaagaaacagccatgagaactcaactgttttccattcagccagatattaaagaacagctaacaaaatgtaaaaaatgccattcttcctgccaaatttttaaagaaatagttacttttcattaaacatgttacttatgttaacatgaaatgggttttcattgtattaacaagattttgttttaatttctgccatggtgcatgttgagagctgtagcctacataagaaagctctttggggttgtaatcattccaacagtgtcgaatggtgctgagccaagacacttcagaagcactcacctaagcggcggcctgaagtgtgctgaagggttttgccatgttgctcaggctggtctcaaactcctaaactcaacgatccatctatcttggcgcctcccacagtgttgggattccaggcgtgagccccgtgcccggcccgtgatttgcctttctactgccacctgccctgtgtggactgcaggtgtcttattcacataagccaggctgcatcacagcacagcataaacaccctctatttacttaaaagggaattaaagaaaatcagcaccacaagaaccttattgtaatttcaccaatattgaggaatgagaacaacaaaataaatgctcggccgatcaacttacttggctccacagaaaatttctgaccccttttacagtaatgcagcccaagatttcaaagacgttttataaaagtcacacaaatgtccagtcgataccatccctgaaccatctccacagctacctctttcctgagcttctcagctctccgcatttcctgccgcatggcgtccaccttctgcgtggccacctccatctcctcctccttgtctcgcagctgccgggacaccttctgcttctgggcacggagctctgccatgcgctcgttcagctccgagaactcctgcagggccagctttcgctgctgatgggcatctttgagttccttggcctgggatttcaaccgctctgaggcttcaaccagttgctgaacaaaaacaattatagatgttttacgtttgcctaacaaaggcttggaaggctggaggttcggtcttccatgatattgaggagttaaaagcgacagccaatgctggttacagattagagccacagatctgagctgcttggaaaaagacctgtgctctgtctcgtgccagccacacaggcaatgggaaggccgcctgggctcaggtgctgagaccaactgcacaccaagaaaggccccacaggccgggcacagtggctcacacctgtaaccccagcacttttggaggccaaggtgggcgggtcacctgaggtcaggagatcgagaccatcctggctaacacagtgaaaccccgtctctattaaaaatacaaaaaaattagctgggcgtggtggtgggtgcctgtagtcccagctacttgggaagctgaggcaggagaacggtgtgaacctgggaggcagaggttgcagtgagccgagattgtgccactgcactccaggctgggcgacagagcaagactctgcctcaaaaaaaaaaaaaaaaaaaaaaaaaaaaaaaaaaaaaaaaaaaaaaaaaaaaaaaagccccacaaccacatgggggcagcgtgcttacaggaggacgctccgtaatgtcagcctctgcccagtgtcacctgcacagccgcaaagctgaatgaagcatttgggcactcaatctagttacttaaacataagcaaaatcaaaaagaacacatatgacacaaagtgctgaaggtgaagtcacagtgaagaactgtataaaaacaatcgctggacagcctgcccttcaatgcagactgatgtgcggatactggctgtcactctgcactcaccacgctgatgaccctgacctccctgcagccaatctggtcaactatctggcagttcagtcactgtcacacctgctggtctgagatggaagtgacaagaccctgagcaagctggcagggcagctcccacacgtgaaggggaggcctccccaggcctctctgggcccgctgggaggtactatgaccctgtcaagcaatgagatgccatgtgccccacactgcacttctagacaaatcactcacgtggatgacccacagattatcttaagaaacaatctgggtttgatacctggcacattttagagaacagatcacaaactacaggttcaagaataacatgtatcaatgaatgtattttagaaaacacgcatataattgtgttagtaacatgctgacacctgagcataaaagtttcccatatattactaaaaatgaaatttataaacgaattatggggggaaatcacccagattttaacacagggtctctgctgcagttccctgtcattactaagggtccccttctaagagcagaggcctggtggagagaaggggagggcctggctcgggacgcagcgtgtgttgccacagccaccatgccctatgcacagccaccatgccctgtggacggccaccatgccctgtgcacggccaccatgccctatcgacatctttcctcgctttagaatgcagtggggtgctgctttctctgtgggtctgaagtggagactggagaggctgattgcgaggtggataaccgctgggggcaagggggtggaaggcacctgccactgggagccaagctctgccagccgacgcgggggctgtgcagcaggcaggcgtggcaggggccccggggccaggcttggccctggcgtcctgcatgcagcagggacagcccatgggcaggagtcccaagaggtcttccatcatcggcatgaacgtgaccttacagaattctgcaaagtcccgtaagcctttctcaccccaaactgagccacctaccttgtgcagctcctccttctcctgccggaccacgcggtgctgcttctccagcccccgcagccgctgcgtggagtcctcacgctcttggcgaagcgccactgtgtcctcaagctgtcgctcgagcctgtttgaatctggacaaaagaggaaataaactctgttcctttatgtgcaatgactatatgtaaactttatgttagctgacttactgacaggaaattatttaataattcacaacactttttcattcagaggtttttttacttacacacacacacacacacacacacacacacacacacacagtgtcataggcacagctacctgcatgcctgtgctgaacaggctccctagactttactctgatctgacagcgatctcccctgagcactgggagcccttgggtggcgcacacactcgtctgctcagtccctctaacctgtgtcacccagcacagtgcctggcccttgtcctttctcagcgtgcaagaaaagttttagttagtaagtgactcaatcaaagaagtctgtttttggatcaggacagtggggttcctgataggaaatgcagagaaggtgagattcaaagtgtgctttggaggtgaaggtcaactgcagagccaacctgtgtgaggttaaggcttaaaagtgattggagccaggccaggcgcagcggctcacgcctgtaatcccagcacttcgggaggccaaggcaggcggatcacgaggtcaggagatcgagaccatcctggctaacacagtgaaatcctgtctctattttgtaaaaatacaaaaaattagccaggcgtggtggggggctacttgggaggctgagacaggagaatggcgtgaacccaggaggcggagcttgcagtgagccgagatcatgccactgcactccagcctgggtgacagagtgagactccgtctcaaaaaacaaaaaaacaaaaaaacaaaaactgattggagcttttagggaactttgataacctaggaaccgccaaaagaaagtggtgacagcaggtctagcacctacaacaccaaggagcaggcagagtcactgattaagctttaggaggaaagcagctctaggaactgtctgaaagccacaaaaaggaaaactgtaacagagaagcagaaaatagccagagaacgtacagataaaatatcaggaactgattctagctggtgactataaaataatatcattagaactaagccaattggggctgggcgcagtggctcatgcttgtaattccagcactttgggaagccaaggcaggcagatcacctgaggtcaggagttcgagaccagcctggccaacatggtgaaaccctgtctctactaaaaatacaaaattagccgggtgtggtggcacatgcctgtaatcccagctacttgggaggctgaggcaagagaatcgcttgaacccaggaggtggaggtttcagtgagctgagatcgcaccactgcactccagcctgggtgacaaaagtgaaactccgtctaaaaaaaaacaactgaccaaaatttgagaactctaaataagcttgctaaagcctaagctttttttctgctttcccactttatgaaaaggactctgaaattcccttttaagacagtaatgaccaaaaatagagactaagaagtcacacttttaaacacatacctgctattttattcttcaagcgttcgatttcttcatttagctttttgatttctttatctcggtttgaattgctgagggcccgagatgagccgtggagggactgcacggtctgggtggactctgagggatggagagacagcgtgaggtgcagcctggccgcagcgcccccgcctggccccggagccggcgctgccctcaccttgcagcttcctgctcagctccagcttctcctgttccagcctccgaatcctcctctcgtaagcttccatctgcaggctgtgctccaggtcccgctgcacatcctcatctttggttaatgtgttggactgcattatgctcttcagagagcctcgatcagaaaaacagctgggaaaccaagcaacaggtttttttgatctactgaaaatttagcgatttcattagcattttcaatcttcctgaggtgaaagatagtctttttaaatcagcaaacaaaaacacctgagataagactttatggtttatggaaccaaagttagacaagtgaccagatggtcaaggagacactgacaagggccctccccatcgctggtcaaagaaagcgcctctgcaaaggaggggaaatggcatttctaaatcatcccccacacttaactataaatgcaaaaccagaaggcatggatcctgcgtaaagcaaggcttagggggcagccccagctcgtctgcaggtcagcggtacgcatggaccactgaaagcttcctggtttggccaccaactggccaagcaatccaggacagctctttcaactcttcttcccctgcaggctaagccaccaattctagcactgaccagcacactaagccccttaccaaggaccagaccactcgatgacgcacacagccgaggcacaggctgaagcccaggatggctctcatttaatagcttaattcttgggctgctttaggagttacttagttctgcttagctctttatgtgacaatgaagtcagggaaattttgagctcctacgcagagttccataaaggcacccagccccctttagagaagacctggtcagtgtttctccacaggtggtctgagggtgctgggctgctccagccctgcgggatctgtcaagaggagagctctaggcctatctggccaaactacagccatgggcttgggacctgcaagtgtgacaagcatttggtgagctggcatgtattagaaagatcaagaacctctgcactgggggctggtaaatcaatatgcccacccagaaagcctcctgtgggctggaagacagcagctgccactttggcttatgggctgtttaaccctggcctctcacaccaaaagagatttcttccaagctcgagcagaagtatggggatatcagccgggcgcggtggctcacgcctgtaatcctgacactttgggaggccgaggcggggagatcacgaggtcaggagatcgagaccatctggccaatatggtgaaaccctctctctactaaaataaaaaaaattagtcgggcgtggtggcgggcgcctgtagtcccagctactcaggaggctgcggcaggggaatcgcttgaacccgggaggcagaagttgcagtaagctgagatcgtgcctctgcactccagcctgggcgacagagcgagactccgtctccaaaaaaaaaaaaaaaaaaaaaagaagcatggggatatctccctcccaagacattttcaactgtggttccagctgccagaggacgccaggaatcagattctgtggcacagtgggagcttccattgtctcatttcacctctctttcttcctaacccctctcctcttggccccagtttccttttaaaatcgaggtggaccatctcaggcgacacaactttgcaaagaggcccatttgggacaggggcccacaacacacaatccttacaaaagccagcagagtgctctgatggaagccagctctcagctgagtgcgcatggcaactgctctgcttgctgtggccaccgactggatcagagctaaccctgccaatgctggcggcctattggtcaggggttggcaaactacggcctctgggagaaatctcacccccctggcctctgggagaaatcctgcccgaggcctgtttctgcaccatcacgagcatgaatggttttaacatttttaaagggttgtaaaaagaagaacatacaacaaaggccatgaaacctgaattctttacgacctggatatctgtagagaaaaagcctgcaaccttgctatggtatcacctgtagtcatcaggtgtgcatattttaagaccaaaaacccatctccatctcccttaagtaatggcctcccagcgcacacaccacccactagcccgcccccagggacagactgtggtgtctgactgttcatctaccacaggggaagtgtctccctggggaatgataaatccagacatacctttccgttgtgaatgtaaaaccaatgaatggcaaatgtaatccagaaaagcctgtgtgagaaccaggaggtaatatttcctgcataagaacatatacaacacaaatgaaatctacattcaaacaaacaggtaaaaagaggaaagatggttacagtcatggtgacaggaggcactgggcagaacatgtggccttggagaatgcggattccatggtgtcctctgcaggggagatgagtatagcagatctgtctttctcaagcctggccctgtacgctgtatgtacaataaagctcacaggagacacactctgatttcgatgatgacagtggcacaggccgtcaccaggttagtgattttcaaagacttcttaaagccacagaattcactgcttaacacaactgtgtgcagagtccaacagtgtgaacaggtatggtccctctgaggaccccggacagagcctggggactctcaggttcttgacctaagacaagaggccccaaggcaaaaaggaacccaaaggtagattattttagataagtttattataactctatttttcattctgaggatctttctttattaaaaactataaccaggggccaggcacagtggctcacgcctgtagtcccagcaatttgggaggctgaggtgggtggcttgcttgagaccaggagttcaagatcagcctaggccaacatggtgaaaccccgtctctactaaaaatacaaaaattagctggatgtggcagcacgtgcctgtaatcccagctactcaagaggccgaggcacgagacttgattgaatatgggaggctgaggttgcagtgagctgaggttgtatcactgtattccagcctgggtgacagaaggagatcagtctcaaaaaataaaaaatataagcaaagttctttatctgggaaatttcagtgtggaaggagttggagtctggagtcagagtctaggacaacaatcctttcaacaatgacaatacttttctcagcattttctccatgtggtctgaagttcagcctttattttgaatgtgaagccatcaaagcaagtattcggtgcaaatagatttaacttttcttgtttttttttttttttgagatggactctcgctctgtcacccaggccggagtgcagtggcgtattctcaggcactgcaacttccacctcttgggttcaagtgattctcctgcctcagcctcccaagtagctggattacaggcacccgctatcatgcccggctaatttttgtatttttagtagagacggggtttcaccatgttggctaggctggtctcgaaatcctgacctcaggtgatccgcccacctcagcctcccaaagttctgggactacaggggtgactcgccgcacccggcccagatttaccttttccatgaccctacaaggggtacttcatagtttctaagaacctctgctcctcccactaaactactaggagtttccccaggttcatggtcattcatttccagaggtcctggggatgaaacatacagagtgaatgatgatgcttcggtgtaagaaactctctaaattaataagcaacgaagaagattttccttttatttggttaaacctcagcttgtctatccccaaacgaagtcacacatgtatgggtttgatgagaacaaaagaattttacgagatatgagcaaaattctccaggaccaaaggtactggctagtgtgtcaaagaggccctgtcagagccgactggaacaccaaacaagtcccacagctggaacccaactcggaaaatcctgatcttaaacatcagtgcggagactcaaaatctgctattatcatctttattctgaactcttgctgtataaagaaacaccaatgcagacacaaagcgctgtaatgttagaaagatttaacgtgctctcacatgtagggaaaagaccagtaactgagaggccgccacactgcctatgggactgtaggctaagcccatgtcttggtgtctttcaacctaaaaaacctaaaatgtggtgacagggtcacagtgaagctctaatacaatgatgtatgtgacactgctttgaaaagtatcaagtaggctgggcgcgatggctcacgcctataatcccagcactttgggaggcagaggtgggcggatcatgtggtcaggagatcgagactatcctggccaacatggtgaaaccccgtctctactataaatacaaaaattagctgggcatggtggcgcatgcctgtaatctcagctactcgggaggctgaggcaggagaatggcttgaaacagggagtcagaggttgcagtgagctgagattgcaccactgcactccagcctggcgacagagcaagactgtctcaaaaaaaaaaagtatcaagtactgtgaaaataaaagcaaaagtatttctgttgagttgcaaaacaaatgagctgtttaactgaattttactcaaattgagtcatccatcattttttaaaggaatattaaggacccagctgaaggctggaataaaaagcacactgtcttaagtgccaaatttcacagctttatggtgtactgacttgataagcaacgccctcaacacagcactgcatgtcagacccacagccagcaaccctgagaacggtgctttcacactcaccgtgtttctcagcacgtcgtcatccacgtcgaagttggatgtgtcagagggactgctcacatcaggaatataaggtgcttctaggtttcgtatattttcccaatttagaccttcaaaaaacgcatgctttttgaaatcctctattccattctgccccagccggcgttctctactgcagatcagtctctggatgaggtccttcgcttcttcagatacatccgtgacatgggatgggaactggaatcgctcctgcaaggggtggcaaaaacaccggtggacaggtggacgcattcagagagtttaaggtgtacagatatgataggaaacaaagtagaaatggtagcttcaaagcaggtcacttcatgggaactaaatgcaatccaaagctaataaatttccattcccaaaaggcaaacaagaaaaccagtggtccttctggttttactcattgtagacttgtgaccacactgcatgtaaatgacacattttacctatggaagtggcaaggaatgtgggaaacatgccgtgcgcgggaagagggacaggcgcagccccgtcagaatgcacagtgcacgcgtcacggcagctccgcttctggaaactcacactaaaaaagcagttactaagaggaaacacaacatgctcaggactgcactgtattttgaccaagaaaactgcaaattacctacatgcccatcaaaaaagagactcgttaaaaaagataccggctgggcacagtgactcacgcctgtaatcccagcactttgggaggccgaggtgggcagatcacctgaggtcaggagttccagaccagcctgaccaacaaggtgaaaccctgtctctactaaaaatacaaaaattaccgggcgtggtggcggcctgtaatcccagctacctgggaggctgaggcacgagaatcgcttaaactcgggaggtgcaagttgcagtgagccaagatcgtgccactgcactccagcctgggtgacaagagcgagattccagctcaaaacaaaaaagatggggcacaaagaaaaaggaacatgtctgtgtgctgctatagaaagacaccacagatacaatgacaaaaaactgttgatatgtaacatgatgccacgtatctaaacacacacatgcgcacgcacacacacgagctgaggtctgccgaggccacacaccctcatggtagagtgggctgagagctgagccaccacctctgtcatctacagaaaggaagaacaatgtcacctgcttcacggagtgcctgacccaagagcccacaggtggtcggcactcagtgactgctggcaggctcttagtaataacgaagtcccagttgttactttaacagaatttgtcactaagaagtggatgagacaattttcattatctacaatatgcatttttgcattgtctgaagtttttatagggggtatatattaatttacaaataaaaatatgcttctactttgggaaaaacgttttttaaaactgtaacttttgctttgctttggagttaaatggaaaaccagttcccgcttcagtgttaatctgctccctgtgagagcgaactgtgggaggccctggctggaggacaggccagcactcaatcaggatcattctgggatctgtcatgtgcacaggagacagcggggagggaaatgctatgagcacgctggtagagagggtgaaatcggcattaggaagacacatgactgactgggtgcgatggctcacgcctgtaatcccagcactttgggaggccaaggtgggtggattgcctgaagtcaggagtttgagaccagctttgctaacatggtgaaaccctgtctctactactaatacaaaaaaattagccaggtgttgtggcaggcacctataatcccagctactcaggaaactgaggcaggagaatcgcttgaacctgggaggcatagctgagattgcaccattgcactccagcctgggcgacaagagcgaaactccgtctcaaaaaaaaagataaaaagacaggcaggagaatcgcttgaactcgggaggcagaggttgcagtgagccgagactgcgccactgtactccagcctgggcgacagagtgagactccatctcaaaaaagaaagacacatgactaaggaaaatttttaaaaagaaataaaaaatatcagacagaagagaaaatgataaaaaggaaaacaaaggaggtggagagaggtgacatggaagtgagaaagtgaacagttcggaaagggaaggaggaaaagaggaaacaggatggggaggatgaagggctccaccatctggagacacatgatcatttacagggactgatttctggggaacagacttgagaatcaaagttggcacctaaccagtgaatctagagccacaggtcaaagggcccacctggacctccccactggctacccccgggcgcctcactccatgcgcctgtgcagacgacgcgtctgtctacagaaacctgccttccctccaggaagccagcttggagcaggccagcgtccttcccctgagagtgggggtgggggtcaccctcagaacctccttccccttcctctggcgcccacatctcctggtgccgaccccgcctctggatgccctctccaatgtctactccaatctgcctgtccccagtttggtccaaaccccgtcacctcttcctcaactactcgcgttgcttcctaacggatcttcctgcactagttgtgctctctgtactttaggcctgagccaggtaccaaaaaaaaaaaaaaaatgcaacgtcttacttcatggttcatgatcttcccataggtctccacgagtgactccgcataaaacggcgtttctccatagagcatctcatacatgcagacacccagagaccaccagtcacactcaggcccgtatttgcccatgccgtcctccatcgcctgcaggatctccggcgagatgtagtcaggtgtgcccacggccacggaggactgcaccttaggggagaaggaggtgctgaaggaaaccctagggcatctccaatcacatatttccaactactttctctaaaatatagcggaggcagaaaatgaaataatcatagaataaaactgatgaatgatcgtgttttttaaacccagtaattcaagctgagtatagtgcctcgagcctgtagcctcagctacttgggaggctgaggccggagaaccgcttgagcccaggagctcaaggccaacacgggcaacatggtccccaaccctgtctctaacgaaacaaaacggaatttaaaaacctcaataatgcaaaattcaatgcaaataaatatccttttgaagcactaaacattatgcggctcccagaatgcatgaaactcttgtacacatggtctgtcaatacccaaataccagccacagccccaaacagtgcctctccaatcccccagggttggcatttcccactctctgtcactgctcccagtgtgatgcaggggccacatgtgcacaggccagcctttctgattttcatgtgcagcacgcagggagtcttgtgtagggtctgtttttagaataaagactccagtggggcacaagaggctgcatttctaataagcttctgggggtactaaggctgctcacctgcagccgaccctgtggtcttcctcatgggaacatgcagaagttggtccaggcattagccgggtgctcaggcattccctggacagcgcaccaggaggctaagaccgctcctacccccgcaagggagaaaacagctcccctgctatctacatcagcaggcaggtgccagagtacagtgacacctctgcagaaagctgcgagggcacgggccacctcagagcaagcgggaggagcctggtgaagctgagaaatcatccaagcagagagaacgatggagagtatagggccatcctgacgggctgagtctctaagactgaggctcaggcaggaactggagacaacaaccacaggcctgtctggggaaggccaggctctcccgagggtcccctctgggaagagagacacagggtccaagcagcaccccagagccagtggtgtgagaactgctcaggctgaatggatcagcagagaactccacctctatcacttccctgcacgagtgcgtggccagcccacaggagctcctacagacagcgggaccactggggtgttgggcggtgactccacgatgaacaactactgtgacggggtggagtggaggtgaggagggtaacccatgctctggttaaaccatgacggggtggtgtggaggtgaggagggtaacccatgctctggttataccatgacggggtggtgtggaggtgaggagggtaacccatgttctggttataccgtgacagggtggtgtggaggtcaggagggtaacccatgctctggttatactgtgacagggtggtgtggaggtgtggagggtaacccatgctctggttaaaccatgacggggtggtgtggaggtgaggagggtaacccatgttctggttataccatgacggggtggtatggaggtgaggagggtaacccatgttctggttataccgtgacagggtggtgtggaggtgaggagggtaacccatgctcttgttataccgtgacagggtggtgtggaggtcaggagggtaacccatgctctggttatactgtgacagggtggtgtggaggtgtggagggtaacccatgttctggttcagacctgttctagtcactggaagactggagtggaggacagcacccgcctaccaattaatcaatatgtggtcaagactattaaaaacaagagactggctttgtggaatgaaaatgagcaaactgctttatttcttataaaacgctgtcaactgaagccagtcacatgggtgcttccactactgcttgaaaatccgccagtaggcaagaaagggattgctctctcggaaaactatttgatgttagaccttatgataagtgtaggtttcaaaaaagaaaagactccaaacatgtaagaacaaaactgcaacagtggccacagacgcagtgaaagcagtttgctgcaagcagctgccaacagggtgtgagcagagctgggactgcccccatcaggctactcggccatgacgctggtctgactgcggggtggagaccacagggcctgtggcctgagcctgggtctcctggtgatagccgatccgggggcaacctcctgttctttccctgctggcgggagtgtcagctggccccgtaacactgagcacctaggactctatttctaggtctacaacacccatagagaggaaacccctagcaggaagttacctgccccaacacaagtgagaaagtacagttacatggttaatgcctgcccacccgaccagcctggacagggccctttaaggaagaagcagggagcgccctcgatctgctacagggctggcatgcttttagccaccttgggattgaggaaacctgacaactcccattctggaaggcacacatattacttttgtaaacataaaaagcaataaagatgctttccaacttaatttttatttgggaaacaaaactccccaaacagaaaatttcaactatctccaaaatggattcattttctgaattaatatacttggtttcttaattgtacctcaaattgaaaacttcccttctgactatatgccaaacccaaaaccaaatggaaaatctccaacaaaaatacctacagtgccatcatcattcatcttcaaacatgatccaaagtcagccaggcggatatgaccattcacgtccaaaaggacattgtcaggtttaatgtctctgtttgtaaaataaacacacaaattaaccatctccatgcaacacattaggtagatcaaagcccttaactagtggtgatcagatgaataaatgctaatatcctcttgtgaacagctgtcaccatccagtacaaatgcctctgtgtgacattcagctggcatggtggcagccgaagtcgtatcactgcccctcgtttagtccccagttaccctggcgaggccctgtgacgattcctactcgtctgcccacccagctaacgagcccctcctgagcatctccttggtgccaggcactgctctccagcccacccacctatgcacgtgacaacgctgcccctgccttcatgaagcctgcacacgagctgaggtcttgcaaacacaaataggcactgctgtctcaggcaggctcacacggtgcaagctctgtgctgagtaccacggaaaacaggaatgggacaaagggacagagggacacgtgtggaggaagctggctgggggctgccacacaaagagacggcagtggccagacgaggtccaggaggcaggtggcgatctgggggaagactgctgcaaaccgccccatacccccaaaactgcactttatagatgaagacatggaagctgagccaactgcccacagttacagagcagcacgtgctggagcaggaacataaacacaggtctgtcccactaacgcctgtttctaaactactttctgtgcgctctcaaacacatgtgcgggtgcagggcacctcagagcatgaatgcttttttctggcacaataagcttacatgactcaacagtatgaatgcaaacaaactttaaaaacaaagacagacattcagcaaaagacaagtacaagcatgttcccagcggcaccacttctaacagccaaaaggcagaaacaatctaaatctctgcctccaagagaatgggtgagtaagctgggctatactcgtgtgatagacaccacaccccaatgaaaacagacgggtaccaactcccccagccacatgaatcaatctcacacaaacatgggcagatgataattcttacctcaaaaccagaaacaaaacacaaaaccagaaacaaaaacacaaggcaaaagaaactctagcatgtaacactccaaactaaaataaaatatcctcaaataaacattcaggaatacgaaaaagaaaacaaaacaaaatcccacaaacacacaaacacacacacacacacacacacacacacacacacacggccaggtgcagtggctcacaaactataatctcagcactttgggaggctgaggcaagagaattgcttgaaccttgggaggcagaggctgtagtgagctgtgattgcgccactgcactccagcctgggcgacagagcaagaccctgtctcaaaacacaaaaacacacgtacacacacaaacacacacgcacgcactagacaaaagcatgcagaaaagaagagctgatttaactcagggaagaaatagaagaaacagataaaatcttatcagaaatgaaattataagaggaccaaacaagaacaaattgaaacaaaaatctaatgaaaaattgaagaaagggaagaaaagatctagaagaataaaatgaggtaaagaaacaaggaaacgcagtcagataggaagcagccagaggctaaagtgggagacaggcaaagaaggcccaacagatgcataactggagtccctgaaagaaatcaaaacaaaacatgactaacatttgactacaatccaacagaactttccagaaattaaaaaaaaaaaaaaaaatacctgaatctagaatgagagggcccataagattaaaaaaaagaaaatatcaatgtcctcttttttgaagccagccaagttgatattgatgctcatatgaaaagaaaagccagaaaaaccctgaagagtgagctgtgatgaggatcaggcccagatgatttcaaaacacactacacagcctccctaattaaagcagtgtggtgctagtgtgtgcagaggcagagagaaaatggaatagagtagaatgtctagaaacaaaccaactacataaagaaatcaagtacaggacaaagataatacgaatcactggggtaaagatagacttaaataaattggtgttgtgacaactggagagccatttaaagataaaattagaactcttccttgtgccgtatataagaataaacctgaaatggacccaagatccacatggaacagatgaacctatatgaatgaaaaagtaaaaatactaaaaaacaaaacaaaacaacccccccttccaaaaaaaaaaaaaaaacaaacaaaccaacacgtgggttttctttttctgggagtaaggatttctcattcgattatgtacaaaaatgtttaaaaatctgtgtggcaaaaaaccacaatgaaccacatcaaaaaacaaatggcaaattggggaaaaatatttgtaatatatattacagataaaaggcaaatacttctttaagaattgggggaaaaaagccagaaatccataataaaagggtaaaaccaatgaaaaaactcacatacacacacacaaaaatacaaacatgatggtcaacatcacgagaaaggtgaaaaagaaaactacaattgtgtaccacctgtcacccatcagagggcaaaaatacaaaagtctgaaaatgcacggttggcaaagctgcaaggaaacaggcactttcatccactgctggtgggaatacaaattggtaatgtctatggagggaaacttacaacatcaaataaacctacgtatgtaatttatttctctcttgatccagcaaccccacttgtagagatttaccctgaaggcacacaaccaaaacaaaaaccaccttgcacaagggtatttatttctacatttataattgcaaaatattggaaactatctaaatgtccactcttaggagactacttgaataaactatggtagttacctatggtagttcgcagtattatgcaaacataaaaaagaatgaagagcaggccgggtgcgatggctcacgcctgtaatcccaacactttgggaggctgaggtggaaggatcgcctgaggttgggagtttgagaccagcctcaccaacatggagtaccctgtctttattaaaaatacaaaattagctgggagtggtggcgggcggctactcaggaggctgaggcaggagaatcacttgaacccaggaggcagaggttgcagtgagccgagatcgcaccactgcgcgccagcctgggcaacaaaagcgaaactctgtttcaaaaaaaaaaagaaaaaaaaaagaatgaagagctccatgaattgatatggaatgatttacaggatacatcactaaagtttttaaaggtatcaccttttgcttaacaaaggataaacaagaaaacgcctgcatggacgatagcagaagacagcagactggctacggatcctgggttgccagcggaggtgggcaggataaagaaggggcgacgcttctgagtacaacttcatgcagttttggaagcacgctaacgtcctacgtactcaaagaataaaactcaatcaacaaaggcggaagggaagtctaaaatggaaaactgattcaaaccaatgaatccaactgtatttcaaataaataacaacactgaagggggagatggggttaaaacaaaacaaaacaaaacaaaacaaatccaagtgacttatgaacacagaacttgaattactgcaggtgaggggtgcagtcccaatgagatgggggagaaccgcaaacaaacccggaatgcctgcgggcaggtttgcttctgtggtgtcctgggcagagcaattctaaagcttttttagacacatctcaggactgagtgagtgcacgtactaacggtgctgggagtcacagtttcagtaggaggaagacaaaagtctggaaagggaggaagtcaggaagttaactcatgattcctgagtatgcacaggtagacgtgtgtgtccatgagtgtgtctatacctctgttactacctctgtgcactgaggggcctagaagcaggcaaccccatagtaatgcgcatgcccagcacccagaacttggtcttcaaagccgctccccactaaagggccttgagctcttctgagaaacaacggagtggggacagagaaggtataggatgagccagaaactaagggcatcctcaaaaagtgaagaggcacagcgcaaacacaggagtcggctagaatgccaaatatgggccaatttcagcacaaaaataactaagatagtgaattaaaaaccactgggagaaagaaggatccatgtagccacactgatcacaaacagaccaatacacagggagaaaggggttgcttccttagaggagaaagccggatgacgactggtcagcatggtgggtctggagtttgtgagtcaatctgcaaccatgcaaagactggtctaggcaaaattcattaatgggtactaaatctctggaggaaattttaaagaggaagaggatatttgcatggtcttaaaagtatctccccacagggaaaaaactatatagcagaaaaatctaacaaaatcttaactgcgtgatgggtttatcaccaccaaggggctgatggatattgtacacctgtggaaatgacaccctgagaaggacacaatatagctatacacacacattccaagaggaaggaacacatcatctcaatctatcagaaggaaacatcagaccaaaccaaagaagtcttctactgaaaaagcaagggacactgtattcgccaaacacatcaatgttcttccaacatgccaatgtcacaacaaaggaaggatgaggaactattctagattaaaagagattaaagaagacatgacaataaatgcaacatgtgatcctggactggattctgtactggagggaagaaaatactgtaagagatgctcctgggtcaactgctaaaatctgagtaaagagggtatgattaagcatgagtagtgtaagtaagaattttggggtaaatgctcttggtacatgcagcttattcttagatgggtgaggaaaaatctgtacgtgtgtgtacacatgtggagagggagggggatgtatataataggagccaaaatattaacaatacgtgaatctgattaaaagtatatgggtgctttttgtaccgttcttgcaacccttgtataagactgaaattttttaagtttgaaattatttgaaacattatttaaaaagaaaacttttaaaagaatgcacatgtaatatgattccatatatatagtattttaaaacaggcaaagctgatttatgctttcagagcctcactgtctaacatggtagcccctagccacagagggctattcaaactcaaattaatgtaaattacataaaatgaagaatttggttcttttgttgcaccagccacgttttgagtgctcatgagccacatgtggctggggctaccgtattgagcagtgcacatctagaacattctgtcactgtggaaagttctgcatagcactgtgggggggatgaggggtggtgacccctggggagggagtgatgggggagccccaagggggcttatctgggtgctgctgtgagcgtgcagttttgaacaatccactgagttgcacccctcggtttgggagctttactgaatacctgtgacatatctcagtaagatttacataaagaagtcaactgaaatggactttaaagttacaaaaagccctcctatcccaactacagataacagtgatttaaaggatgtttttgctgggacccagaaataaaacagccaccagttataaatggcagacacagtacctgccatgcataaattgtcacaattgaccctcaggccagccagtgtggtggggtagagacggtgctcctctcgttacggaagaggcagctgaggagcagtgactgctgccgcctcccagcctgcgctgacagcacagtgacatcacgaatgccagcacctgtgctcacgtcacacgctgcaataacctaagaatccactcaccgcctcaccaactgtttcagcacatcagaattcaaaaacaatttttgtctcacattactttagcagctttgacacaaaatctttaagtctgaaagaaaaaaatcaaaaggaaaacatctgctgaatatacatatattcaaaaatatatatattcaaaaaatatatattaaaaatatatatattcaaaaatatatattaaaaatatatattttatttatttatttatttatttttgagacagagtctcactctgtcacccaggctggagtgcagtgacacaatctcagctcactgcaacctcttgactccctgggttcaagcgattctcatacctcagcctcccaagtagccgggattacaggcgtgcactaccacgcccagctagttttttgtatttttagtagagacagggttttgccatgttggccaggctggtcttgaacttgtgagctcaagcaatccacacacctcggcctcccaaagtgttgggattacaggcgtgagccactgcacctggcccatctgctgaatatattattttcactaataaaaatcctcttttcttggaagtgtctactatacatatttaaatacatctcaattaaatttgcttcagaggaacaaattcttcttcatacgttatatatactacgttcacttcccaacagactccaccagtgttgggaagaaaggcaggtatctgcaactctgaaggctgtgtgcacagggcatgccgcaggtgggttctcaatgagccgctccacatgggatgcgaggcttctggccaagagcacgtctattaacagcacttttggggacatctaacagactctcccacgtccaccagtttttctgcattcttttctcatgaaaaaagagtgaaaggcagaaagagagagggagagttggaaggatgagaggatggaaggatggagggaaagagggagggagggaggggaaatgaagaccaacactcctggaagcagaagcagacccagcccttcccctaccctccccatgaccagggcactcagaagcgctcactcgacctcacaaacttttcaccatggcttcctgcctccactcccttctgtgagtcacccatgtaaataaaagatgaccagttttatgacaaggaagacttgaagcaatgcatacaggacaaatgtatgaagagaagctcaaggaggttgtgtaacaagctctatacctggctgccgggaagaaatggattaaagacaaggataattacactactttatttagactggaacaaactggttcttctccccaaaaatctcatcatttaggcttaacttttttggtttgggaatggaaggcagggcaattcagagaaatggagaaatgattatataggaaaatgtttaaggcaaataaccataatttcacatacacacgaaaaatgtcccaagtggcctgagacaggctaggaagacacagaagagagtaaggaggcgccgagacacgccacaacaggtgttctatggaccgagttagcaggaatgcaacgaccagagtccaggctaaacaggacctggttgccaggaattccctataaaacagggatgtttttccaggggccaccccaggaccaccaacacagtacactctgagaagacaggccgaggaggggtctccggaaggccatcttccttgtataccttccaggggccatttgcacgcactgggggtcatctgcgccgtataattctgtatttaaaacatgtggtggtggttgattttttttttttaagtgaacttgctgtttgtgtgaggaaagctctcctgacagaagagcactggaggttcagggcaagggctgacctatggctcccaaccgccgaggcctttagatgggcagatgcccaggccaactgagagagctgacggtccccatgggccactgtgctgggactgcctatgtccattctcctctaatggcacagcggggagcagcggcgtcttcaggggagagtcaggcacagcgctgagaagcagctctaggctcccccaagtgcattttctcccagctgctgagattctggctaaaatcagtggcatccagcaggtgtgggtgaaagagccatggtgaattgcaggctttatgtctcccttccagctcttcctctgacactgaaaagggaggctgcttctgtccctcaccgtaccatttctgagtgatgtcaactcccacttccatccgttccccttgtggaacttcctgctgcaaaaccagcagaggtctgattcccacagcaggtgtgcctcagcctccagagcacagtccaccacctggggtgtggctccagagccactctgaccgccagatcttctctccgaggttttcttttctttttttcctttttgtcagatttcctctacttcatcttctgcctcttctactcaactttctactttagcttttattttccaagactttttgttttctacatattctttttcttaaaatttgtactctgttcttattttgttcatacactatactctctgctctctctttagggatgtgatgttctctctctctctcttttttttttttgagacagagtatcgctcttgttctccaggctggagtgcaatggcgcgatctcggctcactgcaacctccacttcacgggttcaagcagtcctcctgccccagcctcccgagcagctgggagtacaggtgctcatcactaagcctggctaattttttgtatttttagtagagacaggttttaccatgttggccaggcaggtctcaaactcctgacctcaggtgatccacctgcctaggcctcccaaagtgctgggattacaggcgtgagccactgtggccgatgttctctctctgaaaccctttgtgtcattcatgatctctgcctttccggatatcatcaggggctgacctctcaggaaggagctgtacccacctgtgaggggcacccacagggtcctggtctgccactgatttcctcacccggaaggcttttggggtccagctgcggaaaccaggcagcagctgtgaaacctgcagacccccgcctgcggggtgggatccccacagcacccgactaaccccaggaaggggcccaagcggcagcacagtggcacgggctccaaaccatgctgtaacgtcagccacgccgtaaagttggccacaccgtaacatcggccagcggcaccactctggcgccaatgacatttctttctgaccctaccaaatgttcacaatgcccccacctgagactggggtaagacaggcctcctagaaaaatctctgttctatttttagattgcatctgggcactcagtctgaataatgagttaatttggggggaaaaataaagttttaaaattacatattttgatgtctactatgcccggacgtcaaacgactgagcaaagcttctacacagccaattaagagaatgaggatggctcacgcctgtaatcccagcactttgggaggccgaggcgggcggatcacgaggtcaggagatcaagaccattctggctaacacggtgaaaccccatctctactaaaaatacaaaaaaattagctgggcgtggtggtgggcacctgtagtcccagctactcgggaggctgaggcaggagaatggcgtgaacccgggaggcggagcttgcagtgagctgagatgatgccactgcactccagcctgggtgacagagcaagactccgtctcaaaaaagaaaagagagagagaatgaggagaacgctttctatttagggggagaaaaacaatttaaaaggtggtcaaactaatttccctggagatctgtgataaatacaaagacatttatttctctattgtgaattaagttctaccaagaagacagtataaaatctaaatgttaaaacctatactaacttatgggccgggggaggtggctcatgcctgtaattccagaactttgggaggccgaggtgggtggatcacctgaggtcaggagttctagaccagcctgaccaacatggagaaaccccatctctactaaaaacacaaaattagttgggtgtgatggtgcatgcctgtaatcctagctactcgggaggctgaggcaagagaattgcttgaacctgggaggtggagattatagtgagctgagaccgctccattgtactccagcctaggcaacaagagtgagactccatctcaaaaaaaaaaaaaaacaacctatactaatttataaaagcaagcataactatgttaagaaatgtattttttaaaaagaaagaaagagaaagcaatgtccacaacctcatcacactaaatgagtgtctgttctatcgggacagctccctgtgtgctgggaggtgcgagccatcagcaatgaggctaaggaaaggcgcccacctctctagcctcaacttcctcctctagcaacgaagcagcactccagcaagacggaagagctataactcagcagcgcccttgctccccacacaggaggggctgtgtctgcttgggaaagcctcctgatcaccacggagggggcccgagcacaggcctacagctcagaacacaaagccatggagaccacaatggcctcacacctctcgagagcagcctcaaggtggaagacacagacacatgtgatgcctgcgaagtcccaaggggaaagtggtttccaactaaaatctccacactggataaagcaccagtcacagacacacatggaataaaggcactgatttcaaaaaactctctcatataccccccttccagccaccactggaggacacgcgctaccaagccaaactaaaaagccaagaaaaagaaaaatgaacggctcggaaaagctgggagccagtcccagaaagggagaggggatctctgcacttgaaaagccatctcagaatgagtgcagcacaggacaaatgaggaaccaacgtggaagagaggaggggaacgatggaagggacagcgccaaggaaaaccagatcgagactacccgatgcatgtccggtacggagcttcataacgtggccacaatatctggggacaaattagtgacagctacaaagaaaagctaataaaaagcaaggcaattatcaactccagagaaagcagaagtttatgtaagtgtagttctcaactacaaggctgctgtcatagttacgcagtcacagtattatcaacaccaaatgctgactgaaccatagctgaaaggatggattttaaccattctaatcaggatgacgtggagccgggcgcggtggctcacgcctgtaatcccagcactttgggaggccgagatgggcggatcacttgaggtcaagagttcaagaccagcctggccaacatggcgaaatcccatctctactaaaaatacaaaaaaattagctgggcgtaatggctactcaggagcctgaggcaggagaatctcttgaacccaggaggcagaggctatagtgagtgaaatcacgccactgcactccagcctgggtggcagagcgagactccatcctaaaaaatatatcaaaataaaaatgaaaaggatgatgtgggagaaaggaagacagtttggaagtatatgtgagagagatgggtgacagagagaaagaggtaattatgtaaaagagttaaaatttcaatttcatagatgtgatctaaagccaaaaaagaaaagaaagaaattagcaatataaacctgtgacttaagacacatgaaggcagatgctggaaaaataattttacaaatttacaatagttacctgaccaagtgtaatcagcggggccagggctgggcttggttttggttggaggctctatagaactgtttgactttttaaacctattaccataaaattatcttgtaataaaaatacaagtaaaactagtttttaaaaacaacgaaaaccaaaacaaaccacaggactgaatctttgagtctcaggacaagagggatgtgaagatgtggactcagtggctgagtcactggggagctgccctcccagccgagaaggcagagggggcccctgagagcaggagacggagctgctttaggcctctgccccacacgctctctcagctcaactcctgcaagtcgcagtgatggaagcctcttcctcaagccctatttcctttgtgagtgtcctggggcccttcaggggtcagcacggcacagagaagaccagagttgagaaagaatgtggggacagagggccccaggccccacacgagacatttcagggtggtaaggacagaggaccctgagccccacgtgagccccagggagcacaggcattttagggagggggtcttgggcggtagagacagaggaccccggggcccacgtgagccccagggagcacaggcattttagggagggggtcttgggcggtagagacagaggaccccggggcccacgtgagccccagggagcacaagcattttagggagggggtcttgggcggtagagacagaggaccccggggcccacgtgagccccagggagcacaggcattttagggagggggtcttgggcggtagagacagaggaccccggggcccacgtgagccccagggagcacaagcattttagggagggggtcttgggcggtagagacagaggaccccggggcccacgtgagccccagggagcacaggcattttagggagggggtctcagacggggagaagttgagtcaatgtcaaataaatatcaaaagacacagtggcttcggctgacagcagaccatgacaactgcaacaatgagagctgggatccaccggctgctggggctggaagacggtgatgtgggcaaatcagtctgtgctgcggcagctcaaagtggggactcgctacctacatggcttcttgggacggcctggacttgggagctctgaaaggagtcttttaacaattaaacgtggtttccataaaatatatcagaagccggttacctgtgcacgtaatgaagctgatggatggagtcaatggccagcaccatttcaccaatgtagaacctcgccatatcttccggaagcttgtcttcaaatttgctgagcagggtcagtaaatcaccacccacatagtaatccatgactaagtactacaaattggaaagagaaggggagagaataccacatttagtcaccactaaacctgacagttacaggccagtcttccatggcgaggttctcaggctccaggtctggctcgtggcatctcagctgctcttctgtcacccaagaccctccttctggaacatgcgccccgatgcgtccacgacgccgccatcttcaggggtgcatatggcagagagtggacttcagtaagtgatgtatttaatcaatgggaggaatgatgaaagggcttgaggttggagagggcactctaaaagctagtgacccaaagcagaagcacagttaatagcccatcaatcctatgggtttaaaaataattctccaggccctcatgttatgtgaggacgacaccagaccagagaagggaggcaaagtagttaacatcacacatggtatcagcagttcttattggaaagattatatcataaaagagccgaaagataattacttataggttcactccaacagaaacctcagaaaagctcctacttaagtagaaattggagtaatgggagaaaaaacatctgctaacagggctgagcccgtcacttccccgcgagttccctcgccaccgggccagccgtgtgctgggagtgggcgaccccgaggtgagcctgcgtagagctctgcctgaggacagcctgtctcttgcagcactcagaaagctcagaccacaaagcccacagtctgtggaggccccagtggggagatctcacaggtcagagaggcccaggacaggcaagaccatcacagccagagtcagggtggcagccaacacctccatctctggggccgctgtgcctcagtgaatgctggggaagcacgtggcctgaacctcacaggagccgccttccttggtgcaaatttcctgtgaagagatggatgctgtggtctggacagctagcttttaactaacccgcacagggagtaaacgccctgtttatcagccggggcagggaccctgtaatatttatggagaacctaatcatatcagctgctgtcaccatgaaggcccacgctcgggcccaggctgtgagacacaggccagtgctgtcctgttcacgctcccacctgcccttgcctctggcaccaagaccccatcgacacgggaggcttggggatgggcccggggtctcccagcaagcaaggacagagcaaagacctgggcccaacagtcagactccacgcccatcacattcaaccagactgcagtgtctccaaaggaagggaagcaccacaccggtgggcttgtctgaggaagggagcggcccagctaatcagaggaaacgacagaagccttcattttaggtccctgctctcaacagaatctttaccagcaaactctcatcccttccaagcctctccacagctgtcccaccctgtggagtcttcctcaagcctccctgccaccgccaagggcagccccagcctccccgccctggctcaggcactgcccgtccttccccgccgagtttttcaatttgttcattcgctcgtgcaccctcactgtggccccgccagcccctctggcaacaggggtgctggcatgcacgagacagcgaggtccctggctcagcagagctcacactgggggcgggagagaccgtggccagcatggagagcaggcagtggtgagcgccagctgaccgcaggccgcctggtgaggtgcccaggccagaggttgccaagcagaggcctgaggggagccgcggtcgtgctccagatgaaggggtgcgtgcaaagcggctaggaggaaagtggcagcggcaccctggagcctgccaaaaggggagggccggccacagtgggggctgcagccccacactcagagcagtgagtgggtgatgttccccagctacgttcagaagcccaggcaccgaggtgccactgcgtgtggagggcgatgcagagggggcggtggatgcacactgcaggcattccagagggagcggccccggcagctgacggacacacacggggccaggggagatgcggtgaacgaacggccaggccctcgggcccctaaggaaggccgtggggtcgagtcaagcccttactagctgagccccagccgcgtccacgtctgccgagaactctaagaggaggagcttcctacagcagcactgggtctgatcaacggtctcctggagcatggtctctgaggaaagctaacgcgggagctcgtgaggcagacggcggaggcccactccagaatgagaatcagacctagtctgtcctgtcacagaacgcggggtgctgagttaagccagtaagttttagttagcagtcaaacaggtttaattttgataaaactctgtgagatagctccaatagaaactgtagcagaacccgctctgtgggtggtcagaggaacccacgtttccatatcgctatgagaggcacctgacaccagcctgcactcgggccagcctcacaaccataggaagaggaactggcctaaccctcaacgcccccgctcaaggtggcaggtgtgcaccgcagaagccggccccgcagtcacgggccagaaagcttccaaggcctcgccttcgttttctcatccttaattttcatggtacgtctacctgggcaactccaaaatctcaagaacatggaatcttcacaggggctcctaactgacgtgtgttaacttagaataaacctggcaacacctaacatttcagatggcagcacgctatgctaatttaaaaaaatattagaaacaaaacaagcatcatcatcttcctttgtacagatcccagttgcctgtactccctggaaacttcactcagttcttatcgaaagtggaaatgaactggagacagtccaccggggtcctgggagcagggacactgagcaggaagcgggggggtttatgtggaggtggccccagagcaggggatccggaacctgctcgccaggctggggctgggtcttggtcacaggtgctgtcatccatgtggtcactttgggcaagtgacttcgcctccctctgccccagacacccccttatgaaacagtggaatcactgggtcgttgggaagacggacggggacccctgtgggcctgaaacatcctaagtgctcaacaaacaccagctgccccctctgctgggcaaacacatatatataaagtctacataagtacacatttttccctaatcctgggtgttcaaatctcagggctttctctgatgcttcaagggctcctttagggtgaatggaaggatcccacactactccatctgctgtgaaccaatggagcgcacaacccaggagcttcaggtggacacgcacgttggctgccaaggaaaaggaagcctcgggtccctgctctgaggcttggtgaccacagcgaccacgcccctctcgccaccactgcagaaacagtgccattgggaatgagttgggctgagacctccttctctgaggtctgcccgcgtcacgtccacccagagctccagcagtggacactttcaggttcaggcaaacctagagtcactctaggaataaaaagtcctgaacaaggcggtctgcgggtcactcagcggccaagaccaagggctggtttccccttcaccgccaagtcagctgccttagagtgccgtggaggcgaacacgcttgacaatgcacatgcatgtgcgtcacgaggctggtccatctgtcctgaaagcaagccctgtttaaatcggaaaaatacacaggcagcgtggagactaagagtcacctaaaacctgtcgaaagggcctggggcaccccccccaccgcgggaagacaggaggactgcaggcccacgagaggcactcccggactcagccctagctgagatggaggcaaaaacatccacgtggcttaatccccactgcggttccttattctcaataatccaagattgaaagtgtttcaaactcccagctgatttaaatgtaataaacccagcaaacaaacgaatcagcttctctagtgattagaaaaaaacaaagtccttacttccacatgtgtattttaaagaagttctacctgacaattactgcatgaaaacaagccccgccgttttatcgagtccaatacacattttttaaatgtcagttccacattgtctgactgaatttttagtgacagcataaaggaataaagccggagcgaatgccctgaccgagtctctggctgtgcgacctaccaggtggttctcgtcctgaaaggcgtagtgcagcgcggtgatccactggcagtcgccgttcaccagcacatcgcgctcctctcggaagcacgcggtctgcaaagcaacgaggggtgtcagtctgtgttcactgggaagcaggccagagagcgtactgccggtctcggggtccctcctgggacagtggctccagccacggtgtccctgccttccgggctcctcctcgtgcaccaccccgaggctgctgaggctgagccatccctcatcccttcctctcccaagccccgtgcaagtgccaagggctgctgaggaggcacttgcaccctgctgtcccacgggcaccatttctgtggctgacacttagattcaccccacccttatgtggattcctgactgggctcctcccacctggcacctcctgactcctctaccagatcaacctctgccaagtatcgatggcatgggcagccccacgtgtctgccctctccgtcctatacccactactgagctgctgtgcagctggcagaaggcgcacacgtttgctgaaatcacagtatagtgatgacacaattgtcacagattccactagggaggcctacagccagcagcacagggcaagaggctgccctctaccctgctacgtcttccaaaagagttttaatgcccaggtggcatctccgtttaaaagtcaccaggcctggccgagcacggtggctcacacctgaggtcaggagttcaagaccagcctggccaacatgatgaaaccctgtctctactaaaaactagaaaaactagccaggtgtggtggcaggtgcctgtaatcccagctacatgggaggctgaggggggagaactgcttgagcccaggaagcggaggttgcggtgagccaaaattgcatcaccgtactccagcctggacgacagagccagactccatctcaaaaagaaaaaaaaaatggctggtcacggtggcccacacctgtggtcccagcagtttgggaggccgaggtgggtggatcacgaggtcaggagatcaagaccatcctggctaacaccgtgaaaccccgtctctattaaaaatacaaaaaaattagctgggtgtggtggtgggcgcctgtagtcccagctactcgggaggctgaggcaggagaatggcatgaacccaggaggcggagcttgcagtgagccgagatcatgccactgcactccagcctgggcgacaaagcgagactctgtctcaaaaaaaaaaaaaaagtcaacaggcctttggcataattttaacatgatttcctctttattgagcacagaacaagattcaaactgtcttacatttgaacttgtcaagcttaacaaaaatataagtacattacggagagcttgctatgtgaggcacgagggcacagttctgaccggctctcagctgagtctcacagtgacctctgaaacttatttcttctacaaggttttcttttctaaactttaaaaagttttcctttcaggctggccatggtggctcacgctgtaatcccagcaccttgggaggccaaggcgggaggatcacttgagcctaggagtttgagaccagcctgggcaacatagtgagactccgtctctacaaaagaatcttaaaaattagccgggtgtggtgtcacccgtctgcagtcccagctactcaagaggctgaggtgggaggatcgatgagcccagctgagatcatgccactgtactccagcctgtacaacagagtaacagagtgagaccctgtctctaaaacaagaaaaaaaaagtttttctttcaaaatgaaatggttggctgcacacggtggctcacgcgtgtaatcccagcactttgggaggctgaggcagacggatcgcgaggtcaggagttcaagaccagcttggccaacatggtgaaaccccgtctctactaaaagtacaaaaattagctaggcgtggtggcgggtgcctgtaatcccagctactcgggaggctgaggcagagaatcgtttgaacgcaggagaccgaggtcgcagtgagccaagatcgtgccattgcactccagcctgggcgacagggagagacgtctcaaaaaaaaaaaaaaaaaaaagatggctgttgcagctgtgtcccagttctactaatgacaacatgacaagcggtcaacattcagcttgctaatgtccagacatgcagagaccagcaattctggaatcatcacaacccctctgccaacagccacctcagccacaagggcctggtgaagggacaactaaagaaaacctgagcctcagtgtgcctgacctcctgtcttccagaacgcgcccccaaaaagaaatggtgatggagtgctgagtcccaggtgaggtgagaccgtgggctcaggaggccggggctgccccgaggatctgcggcacctgtgccaacgcctccaggagacgctccctgaagctctgcctggcagctagctgcccagagcatttaggaaaaacccattcttaaactggggactgcctgcaaggtgacctgctgacaggaaacttatgtattatccagcagttttgtttaaggagcagagagagaaacttttagtattttttaaccaagtaagatgaaataaagaccttgcctggtagaaaaattataaactacactgcttagcaactcttctactgaccaacctcttaattcatgcttttaagaaaattttttataaatcagtattataaaatttaatgcttaaaataagtctatgatataaaaataaaaagataaattatttgcaactagcaccatatttatttttatatctcttacacacatatactctagtataatcaccgcgactggcaaacattcttgagcttttctgagcatgccaattaaactggatctgtgtcaccagattcaaattaaatcagcaatatttactctttttaaatgtactcatccaccatgacatttaggtaaataccaaacacctgatacctctctacactttcatgtaacagtagctactttttcccctaaaaatttgctccaataacattcctgtgtttgccactgtttggggcggggaaagggctgctggggctgagggcaggcccagcggaagcacacagtgagatgactgagtgaagatggaggaaaagagagcaaaggcttctcccaaagaaggaagggagaccgtgtacaccccagaagctgggagacccagggggccgaagcaatcacaggccaccgacattttgagaccagggtaactacaaaatggtgctaactctgtcaaccaacacgcgttcagtgagcaacaaatggttgtgagaccttgtgctgggtgccatagcagggaaaggggaaatgggtgcagagcgggggagggaaaagccagaatgactgagtcacgaggaaccgataacacccaccaagttaataaaacccagggccccagagagatctggcccgaatcgatggttgtactgttgtcggcccaaggtggcaaccatcatgggcagcacaggcacaaattccaggaccaaagaggaaagcgtcacctcaaattactagaagggtgagaggagtaagaggagagggtctagaaacccaagaaggacttcccaaaatgaggaggtggccacgtcgagaggttcaactccagaagcaagcgctgaccgcagggctgagcagcctagagccaccgcagcgctgccaggcacaggcctcgctcagggcgggtcagagacacacggggccacagcaaaccattgtgatgaatggcagcctgcaaggaggggactgccaagtgccttctggcagaggcgggagtcacgggagaggatggagcatgatggacggagcagatctgaagcaggaagcaggtcaactggccaggaagggcctgggctctgagtgcaggggaggggaagacaacagggcgggtgaggacagaaactcaagatggccagagaggaaaagcgtgggctccccagcaggcctggcctgccttaggcaggcaggagggagaccaatggcagagcacgcggctgtagaggtggggtcagaggcatggaatggccaccaagaagactgacacggaactaagaaaaaggagctgatcaaagcctgctgggcagtggtccacttcatttctaatcgtgaggatcctctaggtgggaatctaaagacctattctgtatgtgagcagggtccaaacgtgttaattccttttgtgtatggagcagaactgcaatcaatgctgaaactctcccgatgctttttatttgcctttacagtaaacaggacccgccaacattctcgagggtgcactctcaggaacagtgtccagcaagcaagtggtcgctgaggcggggagcagcaggcgccagggaggagactgagacctcctcaaaagagagtgctcgctctgtccggggggcagggaggcccagggctgtggggtggctgcagcttttccccagctggcttcacagtcactttctgctcaccccaagccccatttgtatggcttttcaagctccatacttacctctgctcttttcagcatctcccacttgttgaggattttcattgcataaattcgttcagtattcttcattttgacaacagcaacctgcagtgcaaatgtgagttgaacaaagatgcggttcttgaacaaaaggctagcacgctggagctaaactgtagtgaaatcctaacagcccaggagcctgtgaaaccagcagtgaccgaaagccaagtttcccacctagcatgtgccagttcctgcatcaagaaccttttcttcacagagaaagggaccggccacgtgggctccggagtttcactcctgcaaattcacccctttatggctcgggttccaccactacaggaggttaatggcaggaccggactcctgagacacctatgaggacccatgagcactgacagttaatgtgcccagcacactgtggggcacagtcagcactcagcgcgcggccaccagccacattctttaaagaacaattcaagtgccacctccttcaggaagtcctcttggactttccagtttctaccaaatcttgaataagctctgccatcactaccaacacccgtcaagatgtctgcaccattgtctggtgcattccaccctacgtaagtcactcacacacgggcccaagtctccaactcagcacttcctgtaagctactcactggcagtgacagcggcttccataccttctggctgccaatggcaagcagccagcatgtccccgtgcctgcagcagccatggcctgaagaggtcttaaatggcagtatcatctacctgcctgtttctaacatcaaataccacacagtcacatcgtagagtcactgtgagagctgccattcaccaggcacattctgcgtgccagagacggtgttgagccgcgcatccgcacccccacttcaccctcacagcgaccccagctgcgggggatttctaaaatccatcttgtacagatatggactctgaggctccaagggaacaagaccaaggagggaatccaagaagcaaaggccgcatggaaaggacaggctcccttcaatcagaggagctcaaaaagcgatcaatgttatcttctttgaaactcacacaaaactgagttttgcattaagtttttggcaaaaaagagtactaaaaataaccgtaaaccattctgttaaaacaattttctctctcattccttcatttcccttggtcgtctctctgccctggtgtgcctctccctccctcctaaatgcattctggaaagtcctgccatggctgaagggctctgtgtggcctgggccctgctcacctccaaagcccccatgcctggcacagctcaatgcttggtagcagacagacaggcaatcacttaatgcaatctgtttttacttttaaaaggctttctcaactaggtacagtggctcatgcctataatcccagcactcttgaaggtggaggcaggacaatcacttgtgcccaggagtttgagactagcctgggcaacatagcaagatccctgtctctactaaaaagaaaaaaagaaaacaactagccaggtacagtggtgcatgcctgtggtcccagctacttgggaggctggggcgggagggttgcttgagcccaggagttcaagatcagtctgggcaacatagtgacaccccatttctacaaataataaaaaaaattagccgggcgtggtggcacatgcctgtagtcacaactactcaggaggctgaggaagaagggtcacctgagcctgggtggtggaggctgcagtgagctgtgatcatgccagcacactccagcctgggcgacagagcaagaccctatctcaaacaaaataaacaaactctctgtcccatcctggcctgtggtaaattgactttggctggtgaggcctggatccagggtctgtactgagataaactgggagctccgggcacgatgggacgagccttgcaggggctgctctcctcccctatccctctggtgagactcactcatggggatggtgctgcgagaggggggctatttccctaaagtactgatttgccttctttcacgtctgcacactggaaaatgcacgccctgcacagcaaaggccatctcgctttgtagtggtgtccagtaggtttgctgtgggcagagcacacctgctgctgggatgtgacacagggcgtttccttgtttgatttttcctcagtgaaccaaaaggcacagttccccagccaaggagagcttagatcaaacctcagcataggtgctaaggcactgcacagtttaagaagcaaaacttggccaggcgcggtggctcacgcctgtaatcccagcactttgggaggctgagatgggcggatcacgaggtcaggagatcaagaccatcctggctaacacggtgaaaccccatctctactaaaaatacaaaaaattagctggcctggtggcgggcacctgtggtcccagctactcgggaggctgaggcaggagaatggcatgaagccaggaggcagagcttgcagtgagcggagatcgcaccactgcactccagcctgggtgacacagcgagactccatctcaaaaaacaaaaaaagcagcagcaaagctcttccggtgactcactgtcaaaccacccgaggcggtaccgcggccgctgagggagcctgacctctcccttggtcttggcagaactgttctgcaaggccgaggcaggtctgtggagatggcctggaaggcgaggccacaccgtgccacgggcctcctggggcagggctcccagccccatacaagggacctggtgagcctctccagctgcacctgcatgactggccctcctcccctaggcaaagccaaccggacccagagccacaccgcgtgtgtcaacagcaagcaagtacagagcatgaaaacagctgctattcgaccctctctgtgttttttagaaaatgccaagaagtcaaaattcaattaacaaatggagttttagaaactacgtcagaaggctgggcgtggtgactcacacctgtaatcccagcactttgggaggctgggcggggcatctgggcaggtggatcacttgaggccaggagtttgagaccagcctggccaacatggcaaaacctcatctctacaaaaaatacaaaaattagctaggcacagtgtcagcacctgtagtcccagctactcggaaggctgaggcatgaggatagcttgaacccagaaggcaaaggttgccgttagccaagatcgcgccactgcactccagcctgggtgacagtgcaagacgtccatctcaaaaacaaaaacaaaaaaaactacatctgaagaaactatttttggtcccaacaatctcccaggtcagtcagaagctttcgagtctcctttctcttcattctatctttcagattttctccccagctccttgggaggccgaggcggggagatcacttgagcccaggagttcaaagccagcctgggcaacatggtgagacctcatcttagaaagagagagaggaaaaaacaaactctccaaataatactaattacctcatccccaaaccaatgtataggtgcacaaaaaggtgaaatggaagctgctgatgttttggcaatttaggcaaagttaacaaaatgaagtttatcttacctcaccaaaagcacctcttccaattactttaattatttcaaagtcttctcgatgaagctgcatttctttcaccagctgtgtaaatggtttagctacaagtaaaacagtaaaaccaacaatttagtctaatcagttcatactatataaaaatttaattgagtggggtgttgcactaagttatacttttaaaaaagtttgtttgaaaatatttaatatctgacatgttttggaaagtgagcacttataccaatggacacagatgtggatcctgagcaactgcagccacgcactgggtaacactgttgcagccacgcactgggtaacactgttgcagccgacgacggaccacatacagaacagtgatcccacaagatttatactactgtatttttaccaaatctttcctatgtttagatacataaatatggccaggcgcggtggctcatggctgtaatcccagcaccttacgaggctgaggcaggaggatcacctgaggtcaagagttcgaaaccagtcagaccaacatggtgaaatctcgtctctactaaaaatacaaaaattagccggatgttgtggcgggtgactgtaatctcagctactcaggaggctgacacaagagaatcgtttgaacctaggcgccggaggttacaatgagccaagatcgtgccactgcactccagtctgggcaacaaagcaagactccatctcagaaaaataaataaataaaaatagacacacaaaaaccactgtgctacagctgcctacagtgttcggaactgtcgcacgctgcacaggtgtgtaacccaggagcagtaggttgtgccacatggcctaggtgtggagtaggttttgccatctgagtctgtgacgtgctgttgtcatgttcgcacaatgacaaaaaccacctaaccatgcatttctcaggaggtatccccatcgttatgcaacacacaacagtatacttcagtatctatcatagcaaacatcatcacacaaaagtctcctagtcaaagccaataggtgaacacctatcgagagagcaactgatgggtgcccaaagcccacgtacaggacacaagtgcgtgaggtgagtgagagctgagctccacctgcctgcacgcaggagccacggggcagctcagggaacacaagacattctccaaggcaacacaagtgctggagtctccctggacacccatggcggtcccgaataggtcctgtggcgtctgtaacagtaatgtccaccagtcaggcaccttacactgctcttcccggcctcctcacgcggactctctgagactaattctgttattatccacacttcacagatgagaaaactcagccaggtttctgtgggcactgtactgggctggatagtgtccccagcaaaactcatgtctgctcagaacctgtgactgtaacctcatttggaaacggtccttacagacgtaaccaagtgaaaataatggcacctgctggaatagggtaggccctaagtccaacaagactggtgtccttctaaaaggagagaagtcagactcagacagaggtaaaaagagccaagtggggatggaggcagaggcgagagtgatgcggccgcacacaaggagcgccaagcattgccagcacccccagaagctgagcgttccccggagcctgcgagggacatggcctggctgacgccctgcctctggacttctggcctccagagctgtgagataaatatctgttgtttaagccccccactttgtggcaactggttacatcccccacaagaagctcctagaggccaggcgcagtggctcacacctgtaatcccggcactttgggaggccgaggcgggcggatcacgaggtcaggagatcaagaccatcctggctaacacggtgaaaccctgtctctactaaaaatacaaaaaatttagctgggcgtggtggcgggcgcctgcggtcccagttactcgcgaggctgaggcaggagaatggcgtgaacctgggaggtggagcttgcagtaagccgagatcgtgccactgcactctagcctgggcgacacagcgagactccgtctcaaaaaaaaaaaaaaaaaaaaagctcctagagagaggtcaggtcaactcttcccaggaacacagagcacaaggcaaggccaggactggagcccacactgtctgactccagaccagctcgtgcccgccatgtatcctgccagtctggcatccgtgcagtcaattgtctctcttgcacctgtctctattttcaccttcaagcccaaatctgcatgttttatgctaggtttttttttgttctatctggttctttttcaaattatctatcactacagttttatgaaaggtgcctctgggggaactgagtgaagtgcacagggccctctctgtcctatttcttaccactgcaggagtggctacaattagctccaaaacacatgcgatctgacacttcctgggcttctgactgagttccatattattaatctgactaatcctgtgggttttttctcctttaatagttgctcaacaccactgaggttcgatcaccacaactgcaagagccacagaaggttccaggggcctgggagacagtgagttatgaacaatggcccccatcacagcaaatacacatcagcagagatcaggaaacagaacaaatgagtcctgagttattaaaaaagaaagaaaggccaggctgaagaaaacccttgagctgcactccagcctgggcgacagagtgacactctatctgaaaaacaaaacaaaacaaaaaacagtgaagacaaagacagatgagacgcaggaagcagttcgcaccaaggctgtgcccggaacgtcctctcttttctttccacattaattactctcaagtcacccgggcttccttgtcaagtttccccctactcttttgataaaacacattttgttaattacgtagtttaatagttgtgtacacatttccctaaagcgggcagacacagatgatggtggccaggctggaagtgggaggaacttcgaggcaagcctggggtgaaggcttggagaggcaaaaccacaaaagcaaagcagcaggggacctgtgtgcaggcaggagcaagttcccaaatcagagggcaaaggagaaaagggcccagaaggaaaagcctaagaaaaacattatttctcagaaataccaaatattttcaaactgctccgagaacactaacaattttgtactggtgtataaaaataattaggctgggcatggtgacacgcggctgtaatcccagctactcaggaggctgaggcaggagaatcgcttgaaccctggaggcagaggctgcagtgagccaagatctcgccactgcactccagcctgggcaacaagagcaaaactccatttcaaaaacagaaacaataaacataattaagaccgcattagctacaactagaaaggaaagccgcatcacagtagcagagcaccctgctaaccacacaggtactgagagcaggggacagaacatttaacatgaataactgccaactaggttactaagatggaaataccacatggaggtggcaaatgcaggaagcaccttctgccattaggatcaggaaattaaagaagaggctggaatttttatttgagacagagtctagctttgttgccaggctggagtgcagtaacaatctcagctcactgcaacctccgcctcctgggttcaagcgattctcctgcttcagcctcccgagtagccgggattacaggcacgtgccaccacacccagctaatttttgtattttttttttttttagtagagacagggtttcactatgttacccaggatggtctcgatctcctgacctcgtgatccgcccacctcgacctcccaaagtgctgggattacaggcgtgagccactgcgcccggccgaggctggaatttttaaaacttagaaacctggacaaagggccctgtaaaactgaaactcagacccctgaggatggggtgctgctggccggcactgggtctctgagctcaaaggcagccccacaggctgggtccccagtgactggaaggagtgcagccagctgacgctgggctctctgaggtgactgtggcagggctgttctgctggcgtggggaaaactccaaactggcaccagtggccgactgccagaaggaacttcgctgccaggatggtactgctagggtgtcactctaggagggagcgggcaggaagctgcaagtcgtcctcccgcctcccagccttgtagtctccctccagcacctgcttcaggcagagctcaacagggagtgggggggtcagagctccccaggattggctggggtgtggggtggagtgaggaggacatcagtgccggtgaagcaggtgaggggagggaaccaggtgaggggagggaaccaggtgaggggagggaaccaggtgaggggagggaaccaggtgaggggagggaaccaggtgagggagggtggtcctcttgttacctacaggaggactgatcagataagcaacattcaggatgatggggctgggttcctcactgtccaagtgaggagttatagataaggaagaaaacgagaataaaccgtacaacactgggatagaattgggttattggtatgaacttgcagcttcaatatagacagacagatacagggataaacacagccatatatgggtgtgaacatacagagtcctagctctgtctaccgaagagtatccggaagcagcagcagttcagctacaagcacacccagtgtggaccatggtctctaaagaccattctccaacataggacagggctcctcaggcagctccagagctgggtcaggaaaccgcaaggtgagcctgcagcagccggtgcccagaagtgagagtgtgctcaaaatgaacacaagcagtcacagatcataatctattcaataaaacagggctgggtgcggtggctcatgcctggaatcccagcactttgggaggctgaggcaagaggactgcttgagcccaggagttcaagaccagcctgggcaacatgacaagactctatctctacaaaaaataaaatcatgaaccagggtgtagcggcacacacctgtggttctagctcctctcaaggtggaggcgagagatcgctggagcccgggaggtggaggctgcagtgagctgtgtttgcaccactgcactccaggctggacaacagtgagaacttgtctcaaaacaaaaacaaaaaacaccaggaaatcaggagtccacactgatattaacatataaaatttaaaaatctgatgaaaaatgggatatttatatagtttcaaagtacatccaaacaaaatacctatcaattacgcagggaaaatggtgactttacagtgaagtcaggcagacatcacctgaaatcaagcaatcagagcggccagcatcagttacgtgatgagacgcaaccgcacatcccacaggacacgagggggaaaccatagcctcacttctgtgattttcctgcaaagatccacaacccaaatccaaccaccgggaaacaccaggcaaacctaaactgaagaacagtctccaaactgtcagcctgaaaccttcagcagtgtcgaggtcatgaaagtcaaggaaagacacagaactgatcacacagaaaggaacaaggtcatggtgtgtgtggctctgcagcaaacccttccttctgctacagagcagagtaccagaaaatccgcaatgcttcagtggaatctgaaggttagatacagcaatgtatcaatgctacattcctgattgtgttggttacaccgtggttatgtagaatatccctgtctgcaggaaatacatgctaaagcagtggtcccaacctttttggcaccaggggccactttcatggaagacaatttttccacagacccgtaggggggtggaggaggtgaggtgatggttttgggatgaaactgtcccaccctggatcatcaggcactggactctcataagcagcatgcaacatagatccctcaaatacacagttcacaatagggttcgtgctcctatgagaatctaatgccacgctgatctgaccggaggtagagctcaggtgggaatgctcactcatctcctgccgtggagtctggttcctaacagaccatggagctgtccgtggcctgggggttggggatccctgtggtaaagtattcaatggcaaacagctgggggaggagagttcttctgttatttgcaacttttctgaagtttcaaactatttcaaaaatgttttaaaaatacttttagaagttcatttgttgctatttggaaaacttagaggggcaaggagggagggcccactggatacagccaccaccgccccattaagataacaatggtggcttagaaatgaatgggacagtggtcctggaacagaggaggaagtcgcatcgatagtgttggaactagagtggattgtggcatgggatgagcaaagaagattccaggatgtgcactaggtttctagccacagcagcttgatgaatggggtgctacacaccaaagcaggagaggccaggagagcagcaggttggggtgaggaggggagtagggcctggggcaacggaatccaattacatcacgtagttagtgctacagtctgaaatcgtgaagagaccatctcaaaaaattgatttttcttacaggaccctactgctgttttatattttcaaaaagtgatcacttcgaaaccaccagcttccatggggatggggagaggtgaggcgtgagaagtgggagaaccagcctgttgtgaggcaactagagacagacacagcttccagggaggatgcaggccattcggttttttggtttgtttgtttttgagacagggttttgctctgtcgaccaggctggagtgcagtggagtgatcacagctcactgcagcctccacttcccaggctcaggggatcttcccaccttggcctccccagtagctgggaccacaggcatgctcccatgccagctaattcttttttagagacggggtcttgctgtattgtccaggctggtctagaactcctgggctcaagtgatcctcccgccttggcctcccaaagtgatggaattacaggggtgggctaccacacctggccatcctgaaatatgctaaggccctagagacacggccgccctgcagctcagaagctgggccaggctaaccagccagcactcacaaggctccaagttgcagcaactgggaggctactgtccaccacgccttgcattgcccacaccatcacccacagcgtcagccatggcacctgggcatcatctcagacttctcctgaagagcccgtagccctcacccagcacaaagccacctcttcctgcccgtcttcctcaccaggctctaaggcagggttgatcgctgctcccctggacctgccacgctgacaggactccttcagcacagctgcctgtgtctatggcatgtggcaactgacattcacgaggagtcatcaccaaagggcggccttctctacacagggggttcgcacccctcctaagataaggacattcaacatcttgggagattttccatccaaaaggctgaataaagctttagcctttagacagcttaacttttactggagaaattttctcctcatcaatctcttcattcctcctaccccgaactgtcccctaaagaacttctcttgatgctctagaaaacaatggattaatcaatcaagtgtaaccaccgacaaatatgagatctaaactgtaaggcaaaatggagcccagtgctccctttaaataggaaaagctttgccaagaagaactgcaggcggagggaggatctttgtctaaaactgacagaaaaccattgtgaaatcaaacaagatgagaccagctggaaggagtgcccagggtgggagggtctgaggaaagaggacggtgtcaagagctgaagcctgaggcaggcgggcaggaagtcctgctttcccctgtccggcagaagctctccgcctccccctggatggttctgttcatccgtgccaccctgactgtttgggcctcagctgctttgtggccacaatcaatacatttggaattggaaagagtctgacaggttatccattacgaataataccttttaccaatgaaggtgaacagggccccaatggccaagcaacatgcagaggacacaagggacagacgtctcgcccccgagtcgtcaactccacccacagcgtggttctctcctgaggtcctctccttgtaaccgccagctaccactccgtcccttcaagagatggcaggacccacacctgcctggagcagcacctccacagctgctggagcgcgggggcagctgcaggggaggcacctaccgacggcccagcaagacctacgcggaggccgagggccagaggccaggctagagaaggtatggatgtgtgcgagggcccaggcacactgacgcgctatgcatccggacctcctgcagagagagaaggggccagagcagcaccccagggaccaaggagtgcagccacagtggacggggcacatgctgaacccccgtgagagagagagcacagggcgtgtgccaggagtcagcgccttggcccgcacgtggcagggaatgcaggcgccttcacaggaccaccctggagagagttcacagctccaaaggcttggaatttattcttacggttcagacggctgacgcagctacggaagattagtacctatcacaaagttttagaaaaatgtgttcaaattacacaaaatgtgttttctttgtttcacaataactaagctcttttgtaagatgtcagaatactgcctttgcaaggagccagccacagacccctctcatcaggaatcacgagtctgagaaaagtgactcttcccacaagccctcttaaccccaaatacagttctctaaataggagctctagctgatataggagcacaggctgataaccaggaagtataacgctgtaaaaagaacaaccattaaattttaacttaatgcaacttgagactttagaggattaaaaagggagccctttaagaacacgtggatgtggccgcgtgcagtggctcacacctgtaatcccagcactttgggaggccgaggcgagtggatcacgaggtcaggagatcgagaccatcctggctaacacagtgaaaccccgtctctactaaaaatattttttaaaaaaattagccaggcgtggtggcgggcacctgtagtcccagctacttgggaggctgaggcaggagaatggcgtgaacctgggaggcggagcttgcagtgagctgagatcgcgccactgcactccagcctgggtgacagagtgagactgtctcaaaaaaaaaaagacatcaaggccatcctggccaacatggtgaaaccccatctctgctaaaaatacaaaaattagctgggcatggtggcgcgtgcctgcagtcccagctacttgggaggctgaggcagaatcgcttgaatccaggaggcagaggttgcagtgacccgagatcgtgccactgcactccagcctgggcaacaaagcaagacctagtctcaaaaaaaaaaaaaaaagaacattcagatgcaaaagacaggaagacaagtgagaccacagattgagtctgagaaaacctgaggagcggggtgggccagagcgggggtcgtgtggtacaggcggggatcatgtggtgcaggcgatagcagtctggtcagaagcagcggtgagatcctggctgttcctgaaagtgagacgagcggatttcctgctggatggggcgtgcaggttgacactcgcacagagcactggccaagcactaggacgctggagttgcctgcatgggaaggctgacagaggctggtgggctgagtggcagggaagcagctggacaggtgatgcagttccagagagaagcccaaggtgcccagtgtacagctggtatcggatgagatcaccaggaagtcagcagagagaggggaggggccaaggacagaaccctggggggcttcgacatgaggtggctgcggggaagagaagccagcagggtgcagagaaagccaggacttccatcctggaaggtggatgacaaccaggaattacctactggcttttgccacgtggagaccacaggtggccttgacaaaagcagcagttttgagggaggcaggggacagaagtctgattggccttttgagaatgagagaggtggggtggagacagaagagagaaccctgaagagttcttgttgctgttgtttttgagacagggtttcactctgtcggcagcctggagcacagtgatgccatcacggctcactgcagcctccacctcctgggctcaacggatcctcccagtctcccaagcagctgggactacaggcacatgccaccacgcccgggagatgtttgaaatcattttcaccaaagtgttttgtttaaaaaacaaaacaaacaaaaacaccactcatcttggcatagacggaaagctggcccattccccacgggtgctcacatcacactcgtcaactgatccagctgttagggggcagggtatcacccagagatcacagaggctggagacaagttcattctcactggcttaagtgttaacaataaaccataaattaaattctagggtgacaaaataaacgccccaagcttcaataagcaattgtgagaacacagccaattccttgaaacgaacattattggtgcttgctgcatctgtgcctccacccagtcagtagggggtgtttctctggaatgggctcacccacccccctcaggctcccactgcaccagtccacaccagttctcttaagaactgttcatttacacaccatgaaaaaagcagcaacccacagatatagctattttttttcttttcttttccttttctttttttttttgaggcagggtcccccaggctggagagcagcagtggcgtgatcacggctcactccctgcagccttatctcctgggctcaagtgattctcccctcagtctcccgagtagcagactacaggtgcgcattatcatgtggctaatttttttttttttttttgagatggagtctcactccatcacccaggctggagtgcactggcgcgatctcggctcactgcaacctctgcctctcgggttcaagcatttctcctgtctcagcctcccgagtagctgggattacaggtgcctgccaccatgcctggctactttttctatttttagtagagacgggtttcaccttcttggtcaggctggtctcaaactcctcacctcaggtgatccacctgccttggcctcccaaagtgctgggattacagggatgagccaccatgcctggcagtggctaattttttattttttgtagacacggggtcttgctatgttgcccagactggtttcaaactcctgggctacagtaatcttcccaccttggccttccaaagtgttggaattacaggcatgaaccactatacctgatcctaattgttttttctttggtagaaattaataattttactcactggtttttcttaattttttcctttttttaactgattttcgagtaaaaactttagttttgacaaagaaaatatattcataaacatatacacttttattaagtcaactactggtattatattaaatatatatcttctaatatgcagaatatatatattctaatatgcagattttgcagctcgccaaacagaggtatttaagatcacgcacagatcaattttcaaagacaaaaggcagcacacagtgcagggaaatctagtcccagagggagcccccatgtcagctgggcaggacccttcacaccagcagcactgatgggggcggtgcccaccccggccccaggaacaggatcacaggaaatgagctcagctgctgcactggagcaggatgagaaatcgagaatgaatcctcactccttcctagtacaacgccagagtagtcctaaatatatacagagacgctctcccacacactccaaactgggctgggaccgccaggacaggaaggacgacgtgacagccaggaagagaaccgtctacgcatcttcctcctggaaggcctcggacttgtctctgtttaactgaggcggaaggacagaaaggagccccaatgctctggcctctagagttctgtaacagagtccgtcctaacttactcttcctggctctctaacccttgagactgagacttgctaatacacttctagaagacagtgggcacagcactcataacaaagtacagtgattaaacggtatctacagtgattaaatgcttcctaccccgcattaagaagcagggaggaagagttttgaatgtaagaaagtaaaaagtttgcaaagcatcagtaaataaggttcaaaggagagcaacttaacttcagtaattagtaatttggggaatttttagcaactattcgtaacatccaccaaactcttaggattaattcaagcttataacatagtccttcctatttgacagacttgagaaggcaggatcttttaatactttcaatttgctttttattctcttataccctaaatatttgatgaaatattcaacccacccattgctaatggcagcttccactttctgaacatctacatatgggtcagggatgttatataataatatctctacaggcatatggtctcaaaactcctgggctcaagtgatctgcccacctcggccttccaaggtgctgggattacaggcgtgagccactgggtccagtctaaatgtttggtatttttaatcccttgttatttgtctttactccccacataagactttttacgtgtcagttttaaaattcagaggcaaaaattaactccactcatttttcttgttgctcttaacttaatctagtagacagtatattttgaaatttctttgtgtcactgctgtgaattcagaaaagtctggttttctttctgcacagtaaaataccagctgctcctaatgtcatgattagtaccatcttctgaagaattgacagtccatgcagcaagtatcattttagtttaaggtgaactgtgtctttcaaattacttgagaactggtaattcaagtaagcaattctttcactctcctgtaagcaagcacactgtccgatgtgccacccctctcccccaccaattgcacttggatcgcttaggctaacatatgtgtaccctacggcacagaaattccctcccaggtaaacacccaagagaagtgagcaggtatgtctaccaaaaagacacacacaagaatgttcaaagcagctttactcataattatcaaaaactgtaaactacccaaatgtccactcacagaagagtggataacctgtagtattcatgtaatgaactagtacacattaaaaaaaaaaaaagaaaaaaaaaaggaggagccaggtgtggtggctcatgcctgtaatcccagcactttgggaagccgaggcgggtggatcacctgaggtcagacgttcaagactagcctggccaacatggtgtaaccctgtctctactaaaaatacaaaaattagccaggcgtggtggcacatgcctatagtcccagctactagggaggctgaggcaggagaatcgcttgaacccaggaggcagaggttgtagcaagccactgcactccagcctgggtgacagagcgagactctgtctcaaaaaaaaaaaaaaaggatgaactcctgtcatacacaacactgatgaatcacacggatgtatgtgaagctaaaaaaaaaccagacacaaaatactgcaggattccattacatgagactcagaaacagacacaaccccaagatcatgcaatgggggaaaacagcatcttcaaatggtactggggtggctggacaaccacatgctgaagaataactgtgcgcccctacctcacaccatatacaaaaaaattaactcaaaatgaattgaaggcctacatgtaagaactcaaactacgaaacacttaaaacacggctgggcgtggtggctcacacctataatcccagcactttgggaggccgaggtgagtggatcatgaggtcaaaagatcaagaccatcctggccaacatggtgaaaccccgtctctactaacaaaaattagctgggcatggtggcacatgcctgtagtcccagctactcaggagactgaggcaggagaatcgcgtgaacctgggaggcagaggttgcagtgagccgagatcacgccattgcattccagcctggtgacagagtgaggttccgtctcaaaaacaaaacaaaacaaaacaaaaaaccacatgtaaatctttgtggccttggattaggcaatggattcttacaggtaaaacatgaaaaacaggtaagttaaacttcaccaaaataaaaatcattctgttttttaactacaaacaccaaacctgaacaaaaaaatgttcaaaagaagccattaagaaagatggctgggcatgggtggctcacacctgtaatcccagcactttgggaggctgaggtgggcagatcacaaggtcaagagatcgagaccatcctggctaacacagtgaaaccccgtctctactaaaaatattttttaaaaaattagccaggcatggtggcgggtgcctgtagtcccagctactcaggaggctgaggcaggagaatggcgtgaacccgggaggcggagcttgcagtgagctgagatcgcgccactgcactccagcctgggcgacagagtgagactccgtctcattaaaaaaaaaaaaaaagtgagaagacaaacaacagaagcgtaggaaatatctgaaatcacatatctgataagggacttacatccagaatacacaaaaagctctcccaactcactcataaagacaaatatcccaatttaaaaatgggcaaaggatctgaatcatcatttctccaaagaagatatattaatacaaatgcccaatatgcacagaaaaagatgctcaaagtcattcgcaatcagggaaatgcaaatcaaaactgtaaccagacctcacttcacacccactagggtagctacaataaaaaagacaaatcataacaagcgttggccatgaggtggagagatgaactcttacacactgctagtgagattgtaaaatgatgtagcctggcagttcctcaaagtgctaaacacagttactacatgacccgtcattccacccctaggtatataaacaggagaaatcaaagcatgtctgcaccaaaacttgcacactgcatgtttactaagaaccaggttttaaaaaatttaatataaaaaaaatttgtacatgaatattcacagcagcatcattcgtaatagtcaaaaagtgaaaaccgaaatgtccatcaactgatagctaaataaacagaatgtggtctacctagacaatggaatactactattcagccagagaaagtaattaaataacaatacaacatggatgaaccttgaaaagattatgctaaatgaaagaagccagctacaaaagaccacgtatagtatgattccatttatataaaatgtccagaataggcaaatccatagagacaaaaagtatattagtggttgccaggggctggggagagggaatgctaagtactgctaatgggtacaaggctcaggggcaatgaaaatgctctagaattagacagcggtgagagctgcacaaatgtgtgaatagagtaagaaccaataaatcatacacttaaatcaaaaagccaggcgtggtggatcacgcctgtaatcccagcactttgggaggccaaagcaggtggatcacttgaggtcaggagttccaggccagcctggccaacatagtgaaaccccatctctactaaaaatacaaaaattagccaggcgtggtggtgcgcacctgtagtcccagctgcttgggaggctgaggcaggagaattgcttgaacctgggaggcagaggttgtgatatgctgagattgtgccactgcactccagcctgggtgacagagcaagactccttctcaaaaataagtaaataaaacaataataaaaaaccaagcacaacgaatctgtgatatgggtcacaacagtgtgtaccacacatgagggggtcacaacagagactacttgggtgcacgattcattaatttattcaaaaagtattaaaggtatttaaaaatattcctgaaatgaagcaagacattgtggctacgagtaagcacctgagtccttcagacttcaccgcttactgtgttgcaaaatactgagcatgaactccagtttccttgtgggtaaattaaggataatcccagaactgtgggtgaatgtgacagtggatgtcaacaatgagcagtgccaggctctgagacagccccagcacgcagagccagcctaatcgttttgtgatcacatacgcatcacagaagatgtgctgggcttcccctttcccacagaaacagcatggaagcccctcccaggaacacgcccgtctgcagtgcagctcagtgcctggtgcacagctggcgctcaacaggtgcatgtgagtgaaaagaaacccacagcttccagaaggttcttcctacgtcacctgcctccttctatattctgtgcccatgaacttggacatccagaacatactctcctatctaaatacaagtacatgcaattctcccttaatagggctgttatttatttgtattttatcttttattatttttaaactcattcaactggaaaatactagtgacaagaaaaacaaattcatgccagggactttttttcatcctagcatagatcctgagatcagcagagttgatctgagttgctgaaaccttctgcatataaaccattttcagcagggttcttaacaactgtccagagccaagtactgaattatctgagtccaactgccaatctttctaaattgaatagtcaatatgtcaggaatactatggtgttaaaaaagaaaaaaaggataaaagtaaacatttttatgggaaattttctcttatccaaaattccttcaatcttttaccttatttagacattgactctgcatttctgcatgaggaataagtatgtctctggaagaaaaaatactgttgctaattatatgaaacttctaggacctaatccagcaccagagaagtgaggctaaagaaatgctaaattacgcttgtaatcccagcattttgggaggccgaggtgggtggatcacgaggtcaggagatcgaaaccatcctggctaacacggtgaaaccctgtctctactaaaaaatacaaaaaaattagctgggcgtggtggcaggcacctgtaatcccagctactgaggaggctgaggcaggagaatggcatgaacctgggagacggagcttgcagtgagccgagattgtgccactgcacttcagcctgggcaacagagcaagactctgtctcaaaggaaaaaaaaaaaaaagaaatgctagattggccaggcgtggtggctcatgcctgtaatcccagcactttgggaggctgacatgggcggatcacgaggtcaagagatcgagagcatcctggccaacatggtgaaaccccgtctctactaaaaatacaaaaaaaaattagctgtgtgtggtggtgtgcacctgtagtcccagctacttcggaggctgacgcaggagaattgcttgaacccaggaggcggaggttgcagtgagccgagatcgcgccactgcactccagcctagtgacagagggagactccatctccaaaaaaaaaaaaaaaaaaaaaaaaagaaatgctagattggagccctcagtggccagacacgcatgtgagcgggaagcaatattcaaaacagcaatagcaatccatccagcaactccagccctcccagcacctgaggggctctccagccagcaactccaaccctcccagtgcctaactggctctcacagggtggctgctcctgaaccagaggaagggccaccaagcaaaccgccctcagagtgaggcgctcactttccttcctgaacagaggagaagcgtggagcggccagcccggcctcaccttgcccgacaggagtgaccagtagtcgcccatctccatggggcgtgcccagcacggtatcaaagccctctcatggccaatgaggttgaaggtggaaatggtacctctttttaaaacatttaagaatgtttagaagaatctggttcttttaaaaaagaggcaaagaaagtttgaggagcatagtttggataacaatggcttcactcattttaaatgttatttatttcagcctcaacaattaaatgtgttcaggtggccaggcacagtggcttatgcctgtaatctcagcactttgggagaccaaggtgtgtggatcacccgaggtcaggagatcaagaccagcctggccaacatggtgaaaccccatctctgctaaaaatataaaaattagctgagtgtggtggtgcacgcctgtagtcccagctacttgggcggctgaggcgggaggatcacttcgacctgggaggtggaggttgcagtgagcccagatcccatcactgcactccagcctgggtgacagagggaggctccatctcaaaaaaaagtgttcagggctggctcacacctataatcccagcactgtgggagctgagacaggtagatcacttacgcctagatgttccagaccagcctaggcaacatggcgaaagcccgtctctacaaaaaaattcacaaaaattaggtcagtgtggtggcatgcacctacagtcccagctactcgagaggctgagacgggaggatggcttgagcccaggaggtgggaattgcagtgaggcaagactgagccattgcactccagcctgggtgacacggtggcaccctgtctctacacacacacaaaagtgttcagattggctgccagactacccacctccaatatgtcacatatccaactgaacctaagcatttctgagttactttttttttaattaaaaaaaatattttatgctgatatttttcagtattataaaaacgccggcatgaaggaaatgaaataaaaaaagtacatgacccagacaccaagcagagaaagatggccagtgtgctcctgtatcgtcatctttggctcaccatccccacgtaaacgcagtaataaacaggaaggaaggatgttttcacagaagacttgaaaatgttcttctgatttcatgaaagtaattggtaagccaggaaaactacccttttcaccagatgcctagagatgagacactaaaatcaacaaatgaaagagctttccaaataatcaataaaactttacggcaaagtcagcaaatgtttaacattttgcaaaaggacatctagctttgtgcagtctgcatttcctttcacaagctacaagagctgtcaaaaatgcttctccttaaacaaacgctgcagtaaaaatacaagatttatactaccagggtttatttgattatgaaaattgtacttttccagaacgtctggcgatttccaatttgggatgagcctggtatttctctacaggcgcccacacgcaggcctttccccagtgctctcagcaggaagggcctggggctcccaacagcaccaaggcccagcctctgtgcagcctgatgtgcaggtagaatgcccaacccgtctggcttctaagggctggattccggaaaccaactaaaaagctgatgtaccagagactacagcatcactcacatgggtggacaagtatcaactaatttttctgaacttcaattaaaaaatcaaaaagcttaagatcacattttaaaaagttgagtcctcactaattgtcaactccaaagtgtctccagtgaacaactactataagacctgccttctattattattattattatttttttttttttaagaaaaatgccacaagcccagggcatcctcacccagcaagcagcagagggagccaagagcaccagccggcggccagccttgtggcctcagggcagcggcaggtgtttctgatatgaaggcctggagaagcaacacgtatttcattcacttctccttgtccccctctgctgtctcagagtgacagatccaacctctcatgcccacccacgaggaccaaggagaagggaggtaataacgcacttctcggcctctctgcaaccccgcgtgggtgcacacttgggcctcaggcctcaccagctcctgactggaatatactttaccactgcaacatctgaaatgaaatcagaaatgcctatttttttttacatcgattgaacccccaaatagtttatttcccacaaaatatactgggccaatagtataggaatgatctgtcaaatgccaaatttgtccagctaggaaaacactagaaaccagttaaaacttttgaacaggacaggacaaatgccaattcttccacaaataaactgcaaaaaaaaaaaaaaaaaaaaaggagagagaaagagcttacagattaaaagagattaaggaggtgtacaatccaaatgcctataaaacaaatccacttttttttttttttttttttgagacggagtctcgctctgttactcagtctggagtgcagtggtgtgatctaggctcattgcgacctctgcctcccgggttcaagcaattctcctgccccagcctcctgagtagctgggattacaggcatgcagcaccacgcctggctaatttttatattttagtagtttcatcatgttacccaggctggtctcgaactcctgatgatccacctgcctcagcctcccaaagtgctaggattacaggcataatccaccgtgcccggccacaaatccactttttttaaaaaaaaaaaaaaaggaaatttaaacaatgactattttatgatattgagaaattactgttattttttaatgtcatattattatggctatgtttttaaagaaaaccctcatcttcttgagacacacactgaaatatttacaaatgagatgacagatttctgggattttcctaaaataatcctttttggggaaagggaataaaagtgaaatacaactgactgtgagttgataactgttgaaactggtggttcattattctatatgctctacctctttttgttttatttttgtttttttgtttgttttgagacggagtatcgctctgtcacccaggctggagtgcagtggcgccatctctgctcactgcaagccccgccttctgggttcacgccattctcctgcctcagcctcccaagtagctgggactacaggcgcccaccaccatgcccagctaatttttttgtatttttagtagagacggggtttcactgtgttagccaggatggtctctatctcctgacctcatgatccacccacctcggcctcccaaagtgctgggattacaggtgtaagccaccgcacccagctgctctacttctaaaggtatctgaaatttcctatttgaaattttaaactttgaaatttgaataggaaatattaccaattactatcacttttattaatactcattacacaaataccaccatataaaaaactcaagagactccaaaaaaggaagaatgacattttcatacatgagctcatcactattttcaataatatttaaatagaggatggctgagtgacatgggataccagctagaagtttctgaaaaattagtttccttttacaaatacccaaaacaggaagattgaatcgaaatcactacaagctcctgccccaaaccacacagcagtttcctcactggaagtgcattgcggcaggaaaatcagccccacgcctggtgtatttgccatgagtacgtttgttttattgctggcattccttctgggtcataaagcagttttatgagctgataaaacttctgtacggattctacaaagctgccatggcaaacagcttcagtattcagcgtaacatatctgtctccatctcctgcatctgattgatacaggccctttggactgactggactttcaaaaagtctaagatggcgactctcttactgttaaaatgtttatctaagtcttcctttccaatgtggtactggagaacgctttaggacaaacaagaaacatttaaaattctccataccaaactttatttttaaaaacatttaaggccaggcgtgatggctcatgcctattcccagcgttttgggaggccaaggtgagaggatcacttgaggccaggagtttgagacaaacctgggctcaactagtgagaccttatctcattttaaaaatacacatttaaaaaacagtaaaaatgaaaacatttaaagttcattttactgagaatatttctctcaaattataaatgcagtattttaagcatcattaaacttgcaatacaatcaacaacaggaattaccatagccgggaaaaaaataaactgttaagaaaagggaggtagaggctgggtgtggtggctcatgcctgcaatcccaacactttgggaggctgaggcaggtggctcacatcacctgaggttgggagttcgagaccaacctggccaacatggggaaaccccatctctactgaaaatacaaaattagccaggtgtgatgatacacatctataatcccagctacttgggaggctgaggcaaaagaatcccctgaacccgggaggcggaggttgcagtgagctaagatcgtgccactgcgctccagcctgggcgacagagtgagactccgtctccaaaaaaaaaaaaaaaagaaaagaaaagggatgtagaggggactatgaaatggatactaattcagaatagcctggatttttaaagtttctttccttaatattaaacaaagttttatttatattacaaaccaattattattaaaatgctattggagaaaaactataaaatctgatcaactgaggatctagcagtattcaaaaataccaccattcaataggggcaactagcaattaattctatactttttttttttttgagacggagtttcgcttttgttgcccaggctggagtgcaagtggcacaacctcagctcaccacaacttccgccacccaggttccagcaattctcctggcttagcctcccaagtagcagggattacaggcatgtgccaccatgcccggctaattttgtatttttagtagagacggggtttctccttgtcggtcaggctggtctcaaactcctaatctcaggtgatccgcctgcctcggcctcccaaaatgctgggattacaggtgtgagccaccgcgcccagctcaagtggttttataaatgcatactttaaaatttcactctctaaaatatttttcaggggtcaggtgtggtggtttacacctataattccagcactttgggaggcctgccaggcaggaggatcacttgagcccaggaattggagaccagcctgggcaacatagtaagacttcaactctacaaaatactaaaaacaaggccaggcagccaggtgcggtggctcatgccggtaatcccagcactttgggaggccaaggtgggtggatcacgaggtcaggagattgagaccatcctggctaacatggtgaaaccccatctcttctaaaaatacaaaaaactagctggatgtggtggcgggcgcctgtagtcccagctgctcaggaggctgaggcaggagaatggcatgaacccgggaggcggagcttgcagtgagcggagatcacgccactgcattccagcctgggtgacagagcaagactctgtctcaaaaaaaataaaaaataaaaaaaaataaggccgggcacagtggctcacacctgtaatacaccagcactttggaaggccaaggcaggaggatcgctttagctcaggagttcgaaaccaacctgggcaacatgacgaaacctcatctgtacaaaaatacaaaaattagccaagtgtggtggcacgcacctgtagtaccagctactggggatgctgaggtggaaggatcacctgagcccaggaggtcaaggctgcagtgagccatgatcatgccactgtacttctgtctcaaaaaataaaaataaaataaaatattctttttttttttttttttgagtgggagtctcgctctgtcgcccaggctggactgcagtggcgcgatctcagctcactgcaagctccccctcctgggttcacaccattctcctgtctcagcctcccgagtagctgggactacaggcacccgccaccacgcccggctaatttttttttgtatttttagtagagacggggtttcaccatgttagccaggatggtctcgatctcctgacctcgtgatccacctgcctcggcctcccaaagtgctgggattataggcgtgagccaccgcgcccagcctaaaatattcttaaacacaagactgaaagcttcttaatttttcctaaaactacagtaattctgacgccaaaatattccaaagataacatacaaaagttaaaaccacagactatctacagactactcctcatttggaaatacagatttaaaaaaataataaaaaaaatgaatacgataggctcaactgtgcagttagagaataaaatgccacagctaagcatgttttattctgggaatgcacatatgattctatagcatgtatatcaatacagacaataaaaaatagccaaactaaaatcacagttctgatacatgcaataaccatatttcaacattaatttctcattaaaagtcgtgactttttattttatttatttactgagataatgtctggctctgtcgcccaggctgcagtacagtggcacaatcatggttcactgcagcctcgacctcccaggctcaagcaattctcctgcctcagcctcctgagtagctaggacacaggcccacaccaccacgtccagctaatttttgtgtttttttttgtagagacagggtttcgctatgctgcccaggctggactcaggtatatctgcccacctcttataggcgtgagccaccacgtctggccatctcagacttttagacttatcaaaatcagcttttaatgtttaaaacaatctttcaaattaacattcaattttaatggaaaaagactagaacatgctttaaaataaaaaagcaagaaagacaattataataaactcgggggaaggagactttcacttttcgtggcatacctacttcttgtactgcttaaatttattttatcatgagcacgcttttctttttctttttgacagcgtctcactgtgtcacccaggctggagtacagtggcacaatcatagctgactgcagcttcgacctccccaggctcaagcaatcctcccatctcagcctcccgagcagccgggattacaggtgtgcaccaccatgcccagctaatttttgtataatttgtagaatcggggccttgctatgtcgctcaggcttattttcataattaaaaaaaattaaaataaaaatagtacttgccaaatgtaccttttgtgattggtattctgatactttcaatacatggtatgaggggcaatcccaaatcacagaaaaccgcagctcagcttacctacaactgccctccaaggacgggcccaaagctaagggctttgtaaagcccaaagctaagggaggtggctcaagagatatgtggagaggagtttttaaagaattttaggccgggcgtggtggctcacacctgtaatcccagcactttgggaggccgaggcaggtggatcacaaggtcaggagatcgagaccatcctggctaacacagtgaaacgcgtctctactaaaaatgcaaaaaattagctgggcgtggtggcgggcgcctatagtcccagctacttgggaggctgaggcaggagaatggtgtgaacccgggagacggagcttgcagtgagccgagatcatgccactgccctccagcctgggcaacagagcaagactccgtctcaaaaaaaaaaaagaattttaaaaactggctgggtgcggtggctcatgcctgtaatcccagcactttgggaggccgaggtgggtggatcacgaggtcgagagatcaagaccatcctggtcaacatggcgaaaccccgtctctactaaaaatacaaaaattagctgggcatggtggcacatgcctgtagtcccagctactcgggaggctgaggcaggagaatagcgtgaacctgggaggaggcggagcttgcagtgagccgagatcacaccactgcactccagcctggacaacagagcgagcgagactctgtctcaaaaaaaaaaaaaaaaccaaaacaacttcagcactccttaatagccccaaagcgggcaacccagatgtccatcaggagtggacaaagagagggttgtgaatacagtggacactacacaataaccacaaggaactaagctgcagctatacccaatcatgtggatggatctcagttactcttacttacaattactttttattttttgagacacagtatcactctgttcccaggctggagtgcagcagcatgagctcggcttactgcaaactccacctcctgggttcaagcaatcctcccacctcagcctcccgagtagctgagactacaggtgagcaccaccatgcccagctaatttttctattttttgtagagacggggggggggggcgggtctcattatgttgcccaagctggtctcgaactcctggactcaagtgattcgcccacctcagcctcccaaagtactgggattacaggctacaattaccttttattatggtaaaatatacgtaacataaaatgtacaattttaaccgttttttgagattgaccaagaaaaaaaacagcagcaactcaaattgctaggatggaaataaaagaagggacactactgacattaacagaagtaaagaagattattaagaaaaactatgaacaactgtatgccaacaaattagataatctaggtgaaatggacgaatttataaaaagacacaaactaccaaaattgactcttgaagaaagagaaaatgttaatagatctacaacaggcacaaagattgaactagtaatcaaaaaaataccaagaaagctatccaggcctggacagcttcacaggtgcatctaccaaacatttaaataagagttattaccaattcttcacactcttccagaaaaaggagaacacttcctaaatcattctataaggccagtattatcttgataccaaaccaaaaaaaaaaaaaaaaaaaagacatacaaggaaagaaaactagaatcaattacctttatgaatagatgccaaaatctttaacaaaatacaatactagcaaacgaaattcacaaacacagagaaagaattatataccatgatcaagtgggattcatcccaggaatgtgaggttggttcaacaaacaaaaaccaattaatgcaatacaccatatcaacagaagaaaacgagccacacaactatctcaatggatgcagaaaaatcacgacaaaatccaacaccctttcacatcaaaaacttaacaaactagaaatagaaggaaacttcctcaacctgaaaaggggcatttatgaaaacccgcagctaatgccacacttaatggtgaaggctacacgctttctccctaagatcagaagaaagacaagaatgtccctagtgctgtttctaccctacactgtactgaaggttctaggcagggcaagtagacaacaaaaagaaattaaaggtatccaagttgaaaaggaagaagcagaactatctgtactcacagagataattttatatataaaatttatatgattttttatgtaaaaattctaatgaattcactaaaaaaactactaaaactaattaaaaagttcagcaattttgcaggataaaagatcaatatataaaaatcaatttacctcaggaataaatttaagaaagtaagtgcaactcttacccctgcactgtgaatttaattaatgccactgaattgaacacgtaaaaatagataaagtggccaggcgcagtggctcacgcctgtaatcccaacactttgggaggccaaggtgggtggatcgcctgaggtcaagcgttcgagaccagcctggccaacatggtgaaaccctgtctgtactaaaaatacaaacattagccaggcgtcgtggcgggtgcctgcaatcccagctactcgggaggctgaggcaggagaatcgcttggacccgggaggcagaggttgcagtgagccaagattgtgccactgcactctagcctgggcgacagagcaagactccgtctcaaaaaaaaagttaaagcagcaaactttatgtatttttaccccaattaaaaagaaaactaaacaactctcactctgaaaactgaaactttttttcaattaaatttaaatttatttatttatttgagatggagtctcactctgaagcccaggctggggtgcagtggcgtgatctcgactcactgcaacctctgcctcccgggttcaggcgattctttcacctcagcctcccgagtaggtgggattacaggcggctgccaacacacccagctaatttttgtatttttgtagagacagggtttcaccatgttggccaggctggtcttgaactcctaacctcaggtgatccgcccacctcggcctcccaaagtgttgggattacaggcgtgagccaccatagccattctttatttgaattttaaaagttctaaataagtggaaaggcatcttatgatcgtgggacaagagactttaatactgttaagatggcaatactccccaaattgacctacagattcaatgaaatccttgtaagaatcccagctggcttactattagaaactgacaagctgttcctaaaatgcatatggaaactcaaagaacttagaaagaattgtcaaaacaatcttgaaaaacaacaaagttggaggactcatacttcctaatttgaaaacttactacaaagcaacagtaaccaagacagtgtggtactggcataagaagagacacatatattaatggaatacaaccgagagtccagaaagaaactcatacatttatggtcaactgattctgacaaggattctaagaccattcaacgggggaaagaatatagtctgttcgacaaacattgttggaactggttatctgcgtgcaaaagaatgaatgtaacccctctacctcgtatcatagcaaaaattaattcaaaattgatcaaagaactaaacgtaaatgctaaaactaaaaaactcttagaagaaaacacatgtataaaagaaaacacaggtatgaaactttgtgaccttgcactgccaatggattgttagatatgacagcaaaaaaaacaacaaaaaatatttaaatttgttttcctgcacagaaggggctctaggcagccatggcgcccagccagaatggcatggaagccccacttccacaaggactggcagctggctcgtggccacatggttcaaccagccggcccgaagatccgcagatgcaaggccgggcaagctaaagtgccccacattgccctgcacaccgcgttgggacccatccggcccatcgtgtggtgccgcacagtgcgaaatcacaccaaggtgcgcaccggccgcagctgcagcttggaggagctcagggtggctggcattcacaagaaggtggcccagaccattagcatctctgtggatccaaggaggcagtacgagtccaccgagtccctgcaggccaaggtgcggcggctgaaggagcaccactccaacctcaccctctaccccaggaagccctcggccaccaggaagggagacagttctgctgaagaactgaaactggccacccagctgacaggaccggtcatgcccatcccaaacgtctgtaagaaggagaaagcccaagtcatcaccgaggagaagaatttcaaagccttcgctagtctccacatggtccatgctgacgcccggctctttggcataccggcaaagagacaaggaagctgaagaacaggatgttgaagacaaaaaataaagccctcttgggacttgtaataaatcagcagtttaaaaaaaataagttaaattagacttcatcaaaattaagaacacctgtgcttcaaaggataccatcaagatagtgaaatgacaacccacaaaatgggagaaaatatgtgcaaatcgtatgtccaatatggggcttgtatctagaatatacagagaactcttaaaattcaacaaaaacacaacccaattttttttttttttgagacggagtctcactctgtcacccaggctggagttcagtggcgtgatctcagctcactgcaaggctccgcctcccgggttcacgccgttctcctgcctcagcctcccgagtagctgggactacaggcgcctgccaccatgcctggataattttttgtatttttagtagagatggggtttcaccatgttagccaggatggtctccatctcctgacctcgtgatctgcccgcctcggcctcccaaagtgctaggattacaggcgtgagccactatgcccggccaagacaacccgattttttaaatgagtaaagaacttgaatagacatttatccaaagaagatatacaaatgtctaattaacacatgaaaagatgttcaacaacatccgctattagggaaaagcaaatcaaaaccacaatgagaaacgacttcacacccactaggacagaaaacaacaagtgctggcaaggatgcggagaaactggaacccttgtgggctgctggtgggaatgtagaccactgtagaaaacaacctggcagttcctcaggatgctcaacacagagccttcacacgacccagcaattccactctgaggtatacactcgagggacatgaaaacatatcccacaaaaacttgtacattaatgttcagagaataggtattaaaaataaacaaaaggtactttgggaggcccaggcaggtggatcacctgaggtcaggggtttgagaccagcctggccaactaggcggccaaaagccacctctactaaaaatacaagaattagtcaggcgtaatcccagctatttgggaggctgaggcaggagaatcgcttgaacccaagagatggaggttgcaatgagccaagatcacgccactgcactccagcttgagagagagagcaagactccatctgaaaacaaacaaaaacaccaaataaataaacaaaaggtaaacagatgtccatcaactgatgaatggataaacaaaatgagagctgtccacacaacggagtactatttggccataaaaagggataatgcactatatacgctacaacatgggatgaaccttgacaacatgatgtcagtcatgaaagacccatattatatgacgccacttacagaaaatacccagaacaggcagatatataatgaaagtagatttgtggttgctcagggctggggtgggggtagagttggggataatagctaaaggttacagggttcctttggcggtgatggcgaagatggttgcatgactcgacgaatatactaaaacacaccaacactgaactgtatgctttaaacaggtaaatcatgcatgacttgaatctcgataaagctgttacaaaaaaaaaaaggaaaaaaattatctggtaattgtaaatggcagagaagcctttcttcttcactaaaataaactattagcagtataattcaacttaaatttctctatattgctgacagctggtttctgtttaaaactcctcctaacatattatgtcacaaggattatcaaaacttcataaacacaaatcttgctttttaaaaaaaataattaaatatttgtagaaggaaatatatccaggcttatcattttggttacataaaaccatgtcaatgtctgatgttttgagaaatatttcttgttatgacacagtataatatcaatgccatccctgacaccttaattaactggtaaaactggaaatagagcatttccagtaacttctcaattcgctgctagtcagacagtatttcccacatatttgaattcagtttcattttaaaggtacatcagaaagctgctctattaataaacaaagacttttcaacaatttggtttcaaatacttcgggttagaaaacaaatatccatttaagacagagctgcaaaattattattattactttttggagacagagtctcactctgtcgcccatgctggagtgcagtggtgcaatcatagctcactgcaggttcaaccaatcctcccaagtagctgaactacaggtgcacaccaacacagccggcacctttttttttttttttttttttgagacagagtctcgctctgtcacccaggctcgagtgcactggtgcaatctcagctcactgcaacctccacctcccgggttcaggcaattctcccgcctcagcctcctgagtagctgggactacaggcgcccgccaccatgcccggctaactttttgtgtttttagtagagatggggtttcaccaacttggccaggatggtctcgatctcctgacctcatgatccgccagcctcagtctcccaaagtgctgggattacgggcgtgagccaccacgcctggccctaatttttttaatttaattttgcagagacgggggtctcactatgttgctgaagctggtcttgaactcctgggctcaagcaatcttcccacctcggcctcccaaagtgctgggattgcaggcgtgagccaccgtgcccggcctccaaaattaacctttaaggattgctgcataaccactgataaaatcaacatctttctcaatagtaaagcatcagtagaaatggtatttcaaattgaagtataagatgggtcaggtgtggtggctcacacctgtaatcccagcactttgggaggccgaggcaagaggatcccttgagctctggagttcaagaccagcctggccaatatagggagactctgtctctaaaataaataaataaataaataaataaataaatattgaaaaataaattcggctcaccagttttttaaacaaagtgatagactgaattattttaattcaatgattttgcactaacaagggtgaagtacaacacagcaaggaccctgaagtgctgttttgggtgctgtggcaagggagttctagtcacctttgcacctcgctacgttatttatgtttttagagaatgatgaggggcaagaatatttcttattctgctctggtttattttcaatgggtgatttcctacataccaaaagctctggaggttaaacacagctctatgacatttccagaaagatgaagtttctataggcaactcctgcatcacaaaagcccagctgtgaacagccccacatcacgtggtctccacagggacccctgcaccctcccagccccgaggagcaggcgctgtccagccacccgaggagcaggcgctgtccagccaccgtatttccactttcaacacttccttcaggtactccctgcttcttcacattctcataacccccttctcctctcctccaatgcttgtacagccacgagagaaaaaagaaaaacctgctctcctgtcgtcccatttcctccttctattcatgggggactctttcaagtaagtaagtgtaagaatagaaacagcaacacatccaaatcaaaacaaagaggaactacactctgacttcgtgcagagttgagagctggggcgtctcgcacacctggaaaccacagcggcgcataatcacactgccacgagcctcaaggacaacgtgagctccaggagaacaggaattttgttttcttcactgctgcagtgcctagcacatcttaagtccttaaaaaatatttgctaagtgtacgacaagggatgacagcagactagaaatgtcaacacgattttgcagagtgggaaaaagcaaatggacgagtggtatctaactcagcaaagccagaaaaccagaacttaactgcgcagcaggggcaacgaggctggggaatgagaagaggcgctcagatctctgaaggcctgagggtaatgggcacaaaagagcatccgcttcaagtctgtgggagaagcagtcagatcctcccccaccagccctcctccacctcagccaccttcccagaaactgacagctatgccccccaacccctaaaccccaagcaggagactggaaactcctctctagggagacttacagccccaaaataaagaattctatcactaacttctggcagtggccctcaaattggcagggtccatgctctatttcctcatggtgagactcaacacttaaagtcggccctatgcatacagggagtttccaatcgtcccattcataaccatggaaagacagccagtaatcaccagagtttcggagagaagcctctaacaaagagaatgaccaaagtagaaaacaggtgaaaaagaacgcacaggaaacagacaaggtaggaggcaaagggaaagaaacatctacgtaacaaacgtgtgcaggaatcaataaaacattaaacaaagaaatgtgtctaaaacgcactgccttcatgaaacagaaagaggatgttacaaaaaggaatactgagaacaacaacacttttttttggagacagtctctctctgtcacccaggctggtgtgcagtggcgtgatctcggctcactgcaacctctgcctcctgggttcaagcgattctcctgcctcagccacaagagtagctgggattacaggcacctgccaccatgcccggctagtttttgtatttttagtacagacggggttttgccatgttggccaggctggtctccaactcctgagagttgatccacctgcctcggcctcccaaagtgctgggattacaggcaggagccgccgcgcccagccttacattgaatttttgtttctgacactgtatctttcatttttaagtgttcttggctgggcgcggcagctcatgcctataatcccaagcactctgggaggccaaggcgggtggatcacgaggtaaggagttcgagaacagcttggccaacatggtgaaatcccatctctactgaaaatacaaaaattagctgggcttggtggtggacgcctgtaatcccagctacttgggaggctgaggcaggagaatcacttgaacctgggaggcggaggttcctgtgagctcagatcacgccactgcactccagccagggcaacagagtaatactctcaaaaaaaaaaaaaaaaaaaattagaacaaacattaaaactacagtattatcaacaaaagttccccagagctgaaggacccaagcgtcccaatcaaaaagacccaccaaagaacattagagataaacaagagttccctgaaagcttccagagattttacaaaagaaaagtcccacacagagacttggaaaccatcgtggtctccgacttctcattaccaacactctcagtgtagacagcaatgcctccatgctttcaaacttctgaggaacaatgacttccaacctagaattctgtacgcaggcaaagtgccattcaaatgtgagggaagaaagggcattttcagccaggcatggtgactcatgcctgtaatcctgacacttggggaggccgaagcgggcagattccctgagctcaggagttcgagaccagtctgggcaacatggtgaaaccctgtctctactaaaatacaaaaaattagctgggtgtggtggtgtgcacctgcagtcccagctactcgggaggctgaggcaggagaactgcttgaaccgggaggtggaggttgcagtgagccaagattgcaccactgcactccagcctgggcaacagagcaagactctgtgtccaaaaaaaaaagcattttcagacagacctggttcaaaaaattcacctccgatgaattctttctcaggaagctactagaagattcactccaccaaaagatgaaagacacagaatccagaaaggggaattcaacagaggaaagagacacgaagaatccctgcaaggaatgaaaagcactccaaggaggactgctcagtagcaggcccgcaggacacccggcccaggctgaaacagaaaagtggcaggcctggaagggatgaaggtgataagattatgtgaggtgtttaatggaggagttctagttaaaagcctggcactaaattcatgactgtacattgaaaaccaagctaaagaaaattcggccgggagcggtggctcactcctgtaatcctagcacttcaggaggccaatgcgggcggactgcttgaggtcaggagttcaagatcagcctggccaacatggtgaaaccccatctgtactaaaaacacaaaaattagccaggcatggctgggcgcggtagctcacgcctataatcccagcactctgggaggatgaggcaggtggatcacgaggtcaggagatggagaccatcctggctaacacggtgaaaccctgtttctactaaaaatacaaaaaaaaaaaaaaaaaaaaaaaaaaaaattagccaggcatggtggcgggcgcctgtagtcccagctactcgagaggctcagacagaatggtgtgaacccaggaggcggagcctgcagtgagccgagatcgggccactgcactccagcctgggcgacagagcaagactccgtctcaaaaaaaaaaaaaaaaattagccaggtgtgatggtgggtgcctgtaatcccagctactcgggagactgaggcaggagaatcacttgaacccgggaggcggaggctgcagtgagccaagatcatgccactgcactccagcctgggcaacagaatgagcctccatctccaaaaaaaaaaaaatttactccatgggattattataagaaaagaaaataaagaaaattcactccaataacacaaaactatttcccttagtaaactgtatcttacatggcttagctgtgaagacagttacctaacaataagaatgcagacactgaattaccaatttaaacaaaattatataaacatatttggaacacagaaaaagagcaaggggtgaatgtgtttcaggcagtggagggacaatgtagaacagttctaaggcctcttctacagcagaagtcagcaatgtctaaaatggtaaaatcagaaattagcagtaccagcatgctacacagaaatatgaaatttaaggcaggcattgctaagcacccaccaatatccaaggatcttctatagtaacatcccacccccggcctgcttggctgaaggagggtgggatggccaccgtctcagatggtggcctgagggtgggaaaaggccacagccccggaggcctcttggagcaaggctgtccaactagcactgactgctgacacgtcaacttcacgtgagagaaatcaacctgattttatttaagtcactgtcactttgttctccattactggcagctaaatgtgatcctaactaaaatgataagtagaaacagagcagttaaaagtggtagtctgtgggaagttggagcgcggagcaagcgactggtagagggactgctgtcttgcactacaacccagtagtaccgcttagtttccaaaactaagtaaatgcattacattgataaaagttaaatgatgttaaaagaaaatcaccccatggggcatggtgggaagtgctgttaaccttaactttttttatttatttgagacaaaattttgctcttgttgcccacgctggagagcaatggcacaatctcggctcactgcaacctccgcctcccgggtttaagtgattctcctgcctcagcctcctgagtagctgggattacaggcgtgcgccaccagcccggctaatttttgtatttttagtagagacggggtttcaccatgttggccaggctggtcttgaactactgaccttgtgatccacccgtctcggcctcccaaagtgctgggattacaggcatgagccaacacacccggccataaccttaacttctaaagctaagattagatgcgtcttttggggtcaatttcaaattctaatactgaattgtggatatcagactttttattttaaaggcaacagaatatgaaggcattgtagttttggaaaggcagagtgatgaagagagtttgagactgatctggcagaggtatttaaaacttcaagtgggaaaggcattcatttaggcctgaggacctgagagctttacctaggtccctgacaatgagaatagaaagaaaaggctaaaataaaataaagatatttcaaagcaggcacctgcaaggaggcctgaggctgaccgcagtcctgtgaaggacagaaatgctggttagagggctgtttgcccagaaacggttagggaaaatgctcagaacctggtttacccaacctgagtggggagtgggctggagggcaggttaacatgacctccccaaattcctaacatagcggagcgcagtggctcacacttataatcccaacatttgggaggccaaggtaggaggattacttgagcctgagttcaattccaccctgggcaacacagcaagacctcgtttccacaaaaaataaaaaattagccaggtgtagcggtgtatgcctattgtcccagctattcaggaggctgaggctggaggactgcctgagcctgggaagtcaaggctgcagtgagacatgacagagccactacactccagcctgggtaacagagcaagaccctgtcttggggggaaaaaaaaaaattcttaacagttttccaacctatgactctgcaattttggaggtcagggaaatcatcacctaaattaacactgggaatcaccttacaataggtcccaaatgttctccaaagactctccaatccaaggaccgaatttgaatgaaattatatcattccattcaaatttatgtttgaatttctaattcctaagaaaaacaaaaatccaaagaagttctctattacacatcgattttttgcagttttaatcaaaaaacaattttgttgccactgttacctaccaatcaataaaactaaccaaaaacctaacccccaacacagattgtttaaaatcaaactgaaacttgacctttatctcccagttagtggctagtgtatttggggcgggggggcgggagattactacacgcagttcacattgccaaaacacttctgattttagatttaaggagagggtgtttcctctcatccattctcattagcaagagaggctttctgtgagcttctcacacaaatttaaggtaaccataacataccgtcatcccataacactaagaatctaagaaaaaaacaaacgtggtcaaggactaataggtattatgttatgggttttgggatgagattacatggtaacattgtttttagtctcttccagctaaaaaaaaaaaaaaaaaagctttgtctcttttcagagaaaagcatttgacagtttcactgtatttaatatagtttggaattaacagtcctgtgtgcctgcctgtttatccagtatcactaatgtcagcgcaaccaggagacatctaagggcacctggcttgcgacaagaggcagggcggaggcaagcagaggagctctctgtcaaccctgcagtgttgtgagttctgtaatttacatgcatttgagtattttgcctgaagggcaattcactgcacattttaaactttttcaggtagctcacacagtggtatcctgaagtgagaactatttcttcaaatccaattttatttctttgaagtctagatttaagagagacactgctgctcactgtgaagcccaactgtcatggaaggaagaggttttttgttttttttttggagacagggtcttgctctgttgcccaggctggtgtgcagtggcgcaatctcagctcaccgcaacctctgcctcctgggttcatgagatcctcctgcctcagcctcccaagtaggtgggactatgcgtgccaccacacccggctaatttttgtatttttagtacagacgggttttcaccttgttggccaggctggtctcaaactcctgatccactcaccttggcctcccaaagtgctgggattacaggtgtgagccaccacacccggcctgaagttttaagacagaaaaggtagggctgggttgttaatgtttaatggtttcagctgtcctatctcatgctattatagtcagtatcaaacagctaccatagaatctacatgatctaaattaggttaaactaatttttatcatgcaatcctaacatttccctataattcagatcttactcaaaagatctatttcttaagtctgttatttttaaaaagtgttcccatgttatgcaaatattctatccagagaaatcattaagataaaaatgtatttgagccgggcacagtggctcacgcctgtaatcccagcactttttattatgagatgtttagcaccgtgtcagttaagccttacttattaaattcggtggcatcatcccactcacaccttgggctggccattcccacactaacagctatgggcattcacatccatggaggaggaccgtgagaagatactatcacactcatggtgagaaaagccacaaatgaggaaccacccagaagactaggaggattaattctattcatgaagaggaagcacatctcgagagaagatgcccggactggggactggaaacccacggtccgcctctgtgacaccagcatcaagcctgaggcctccctcctggtctgacggccacacagcagccagggcagaggaccactgtggcctgtccaatgcccataggctaggatttcaaacatcagctccatccaaacgcaacattagctgttacaaataagctgtgggaaaaatatttaacacataagacagtatttgtatatgacaaagatgaaagacaacaaattcatctcactgggttgtccgtatttgttgctatttacttttggaaactgtaaagtgtttcatatgttctgcttcaaatggtatcaagatattttcaaaatagcttaaagaaatatacatgcaaggccaggcgtggtggctcacgcctgtaatcccagcactttgagaggccgaggagggtggatcacgaggtcaggactttaagaccagcctggccaagatggtgaaaccccgtctttactaaaaatacaaaaattagccaggcgtggtggcaggcacctataatcccagctactcgggagactgaggcagagaattgcttgaacccgggaggcggaggttgcagtgagccaagatcgcaccactgcacttcagcctgggcaacagagtgagactccgtctcaaaaaaaaaagaaaagaaaagaaaagaatacacacgcaaagctgggcattaaggttcaagatttcatagaggaaaccaatcaagctataggaaaattaaagacaaaaacctacaatgaaagttgaaatgactcggccaggcacggtggctcacacctgtaatccaagaactttgggaggccaaggggggcagatcacgaggtctggagatcgagaccatcctggctaacacggtgaaaccccgtctctactaaaaatacaaaaaaattagccaggcgtgatggcgggcgcctgtagtcccagctactcaggaggctgaggcaggagaacaacgtgaacccgggaggcagagcttgcagtgagccgagatcccgccactgcactccagcctgggcgacagagtgagactccgtctcaaaaaaaaaaaaaaaagttgaaatgactcttgtcccatgcgaccactgtggcaataagaaaatatgagccaaaaataatcatattttatttatttttgagacagggtctcactctgttgcccaggctggagtgtagtggcatgatcattgctcattgcagccttgacctcccaggctcaagtgatccacccacctcagcctccagagtaactgggactacaggtgtgcgccaccatgcccagctaatttttatatttttataaaattttattttgacatttattatagatactgggttttgtcaggttgctcaggctggtcttgtcttcctgagttcaaccaatcctccaccttggcctcccaaagtgctgggattacaggcatgagccactgcaccaggccataatcttcctttaaaacttaaaaagtttactacctatactttccaaatttcctcacatattccccattaagcctccaaatctgggctgaatcagctacttttcttccttaagtttcaagaattctccataattgtcattagatacctggcaagatttgggaagtggggaaaggttggcttttccacgtgacaggaatcgacatatcagaggtttcaaatgtcatggagtggtgaatccaaaaactgaacagtccactgatggacagcctatatgtgtttcctgagcagaagtaattccacttggaagttagagtacctaatattgctctataaatagttttattcaaaaacattattctgtgctttccaatcgaaacaaccaggcaattccaagcaacattaaatactaactgcacacatgttaactagaaatacaccactttagagttacaatgacgtatatgttaacataaatgagtttaaatacttgtaaaatatattgatatttcattaaaacaccaccttctaagtccattcttccctataattgaaagtttatacttttgtgcaaactgagttcctgagaataatgtagtttgtaatcacaatttccaaagagccagaatacaactttgaaaatatgtctatgttacagcacagttcccgtttagatttggaaaggccagatctcataaaatatgacctccacacatgctgacaagagcttcctccagggaagcccaccagtaatgcctggtggagagaggtggctgcacaatggcccccagggcccccgccctcagactaatcttctaggtcccaggccagaggccagtgggaccacatcttcccagcaaaaccaactttccctctgcttcctcttcccagtcacactcacaggtggtgcaccaagttgaacctgacagtggaactgtgtgggtttcaagatcgagtgatcagaaaggaacggtaaacaagctgggtgcagtggctcacgcctgtaatcccagcactttgggaggccgaggcaggtggatcacccgaggtcaggagtacaagaccagcctggccaacactgtgaaaccccttctccactaaaaatacaaaaatgagccgggcatgctggtgcgtgcctgtagtcccagctactcgggaggctgaggcaggagaattacttgaacccaggagatggaggttgtagtgagccaagatcatgccactgcactccagcctaggcaacacagtgagactcgtctccaaagaaaagaaagaaaaggtaaacaaaatattcagattttaacatgcaccaaagacctcactttcaaagcaacggtgaagtcaattaattattcagttggaaatcgtgtcactgacaaaggacgctagaaagcaaatactcttaatttactgatactataagtaaccaagaatggtggttcccacggaaataaagcatcacaggctgtccttgatctcaggacctctttctactgctgctctcacaagataccgtgtaacatttcactacagagtaatccaacagaagccctctaaagaatattgcaacttaagttttatttgtaaacaaaattccaaattccagtcaccaatctggcagagtagagtaggaggcctggaggcctcactgtggaacactttcatttgtttcttcgtataaatatcagctttatcagccccaaagattagaaattactggttcgaactgaacagtcctagcccagtgacgcaaatgacccaaggataaggttttcataggtttggcctgaacatacgcatttcctcctcctactcagtggttttaggtgagacagtctgagggtcttgaccggcacacccgttagggagagatgaagtaaaagagtttcacgctgcacttttacctgtctttaggatcctaattatcgttaaatggtttaatcaaatttttgtcctaaaaaagcataataggttagctgaccaatgattaaaacattatagatccggaacgaactagagaaggcatgcaaaattcagatgagaaagtttctaagtgatagctccagctacccctccaaatatcacaaaggtctagcagaattggaattaaaaaaaaaaagtcctcttgcacggtttatttaaaataaagccttaaccttaaaattcccttgaaggtgttacagcaaagtaggtattcaggctctgaccaacaaggggatgtagacaggctgtcacccaggaggggccgttagagctgggctccctggggatgcaagggggtcccacggggcagtgggcgaggcagatgcagaaagcacacccagctgcccccacaacgcagagaagcgtggggtggggaaagggaactaattccacactgcctccggaccccaaaggcgaggtgcgggggcgggggcgggggcgggggcggatatcccagtgagtgctgcaggaaatgatatccagactcggagggtggatctaggaagccgccagggcgagggcccggcgggggggagggggtgggagtgggaacgtaggatgtggctccaaggggcaggatgagggggcgggacgatcgaacgcggatgtcgagcctagggagggcaaggagggatgaaaagctagcggagggacgagggtgcaaggagcggctggagagagatgggctgcgggcctgggggcgctgccagagcgagaggaggcgaagcccacgagctgggtgggcaggagggcggcagggtctgtccgggcggggatgggcgggcgtggggatgcgcgggctggggcgcgggggtcgcagagccgcaggtccggccctgccggcgcgcacttaccccactcgaggaactcggccacgtacttgtcgcggcgcagggccgagtggctgcactcggtgtacaggcagacgagcacgtcgagcagcgtttccacgctcagggcgctctcgttgcgccagggcccgtccaggagcagctgctccagcttcttgagccgcaccttggccgacatggtgccgcgcggcccgctcccgacgcgccggcctctcaccgccggctcggccagtccgtcagggcgcgccctcgggggctcggcggctgcgagccccggcagcagcggcgcctcctcgccgccccgtccgcgtcgtcgcgccccggcctaggccgacatcttgggctccgtcccgacggcgcagagtctggggcgccgggccccgcgggtccatgggccgctctcctcccct

SEQ ID NO: 1265 - DNA, 139520 bp, Homo sapiens
gcccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttaagcacggtgcctgccgctgtacatttcagtaaaggggagcccctgctgtcatctgtgctagcctgcgttctcgccctctagtcccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaaagctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttgatgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgatccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaatcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcctgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacctaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcatacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctttctttttggtgaggatttaatgggtttgtgtgctaagaacagtttgtattaagtacagacggttttcaacttacagagtttcaacttactattttttgactttaagattgagcgaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaaaaagaaagaaagaaaaaaagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctggtcacactgctgaagatcacaatcttaaaatccatgcacagaggcaccctagtcacactgctgaagatcacagtcttaaaatccatgcacagaggcaccctagtcacactgctgaagatcaccatcttaaaatccatgcacagaggcatcttagtcacactgctgaagatcaccatcttaaaatccatgcacagaggcatcttagtcacactgctgaagatcaccatcttaaaatccatgcacagaggcgtcctagtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggaggggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgtttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattacgtatttttttaactttactgaggaattactagaaatttttggtacatattacacgcataaacacagcaacacaaagatttgttttgagctttggctgccagttattagtggtttaaccccagagatgaattaaatatttatgttgttgttgttgtcattttcatcatgagagctggctgggtcttagaatcatttggtacaatccccactttttatagataaagaaattctaagattcctgcttcaaggcacgtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccaacatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtggggtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgttttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcagcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggtttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctctaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggtcaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtgaatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacctgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagttagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaatattcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttagaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgcccagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcctgcctgcacccaggtgaaataaacagccatgttgctcaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacactttttttttttttttttttttttttgagacatggtcttactcctctcacccaggctggtgcacagtggtgcaatcacggctcactgcagctttgacttcccaggttcaggtgattcccccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactgagtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatatatattttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaatttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgtgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggctcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcactgcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttactgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctgtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgctgtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaagggcatcaggagagaacaggagttggggggtcagaggagtcggaggccatatggagggacatagcagctgctgcgagaccgggggctgaggcagcttcgacgggcctgagtctgtagcatggaggctgtgcacagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcaatgaggtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccactcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccagaacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtggcctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttgggtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttgttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttctccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttacgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtcagcagaacatgaagttcatcttctcctcattgaagttttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtggaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacagttgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtggtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaataaataaataaataaatataaaaagaaagctatggcaaattattttactgattttaatatatgagcttcttgaagaacaaaaactgtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggatggtcttgatctcctgaccttgtgatccgcccgccttggcctcccaaagtgctgggattacaggcgtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatacacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcaattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcgcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaaggtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcgctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgcccgcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgagtcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatatagcaaaataccaaaaaaggaaaaataagccaataaccaagtcaaaatgaggtgtggagttctgactgtgtgtctttggggcttcttcccatcttcctggcaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacccttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctattcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagctgagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcatgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtggttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaaggcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccaacctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggtgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcaccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggcggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgcccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacacctgtaatcccagcactttgggaggccgagacggatcacctgaggtcaggagttcaagaccagcttggccaacatggcaaaaccctgtctctactaaaaatacaaaaattagctggacgtggtggcaggtgcctgtaatcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctcgacttcctgggcccaaccgatctcagcctcccgagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctttgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagcaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttatgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagattggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcatgatccacctgcctcggcctcccaaagtgctgggattacagacgtgagtcactgtgcccagcctaattttatatttttagtagagatagggtttcactatgttggccaggctggtctcgaactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccgtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggcgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcaactaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttctttttttttttttttttttttttgagacggagtctcgctctgtcgcccaggctggagtgcagtggcatgatctcggctcactgcaagctctgcctcccaggttcacgccattctcctgcctcagcctcccgagtagctgggactacaggcgcccgctaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggttttttgttgttgtggggttttgttttgttttgttttgtttttgagacggtctctcactctgtcacccaggctggagcacaatggcgcaatcacagctcattgtagctttaaacttctgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtctgctctggctgaaggcctccttttccttttctttttttttttttttttttttgagttggtgtttttgcccttgttgcccaggctggagtgcagtggcgcaatctgggctcactacagcctctgccccccgggttcaagcgattctcctgcctcagcctcccacgtagctgggattataggcacctgccaccatgcctggctgattcttatattttcagtagagacaaggtttcaccatgtttgccaggctggtttcgaactcctgacctcaggtgatccacctgccttggcctcccaaagtgctgggattacaggcattagctactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcgggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtgtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaataaaatcttgtacataagccagatgtgttcaacaagtaacagcaaaactggtcccatgaaactgccccttccacaggggccctgaggcacctctgcaaggccagggccccacaggcgctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagagctgggattataggtgtaagccactgtgctcggccttttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttggtcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttagtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagctagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgaggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccacgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcccggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacattctggagacaagtgaccatctcccccgtgagactggcactaggggcaggacgtggcctctctgcctcctgcggggcccacactggctgctgcatgctgccactaacatgtccccagttccggaagtctcctgtcctttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccaggccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggggctctcaaagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaccccacaggctgtgtgattgacaagtatgtgattggctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattca

SEQ ID NO: 1266 - DNA, 113841 bp, Homo sapiens
cgccggggtgagacgggtttattgtgcacatttacacagcgtcagcagcgtctgggctggcagcggccatgctcctgtggtcgggctgctctacaagggcgttcacttttcttcaccacactatgtacagtcagtgctccaaggtgatgggctacagtgctgcatcagtgagtctgtacacacatttttacataaattacacacgactcatacatgaaaaatagagcctaagggcctgtattttaatgagaaaaaaaaaatttccaacatagttcgggtagctttgaatggtctagtcaaaaaatacttttggtatataaaaagcctgtacgtacaattcacacctcagtgaagcgccctccttgccttgaggctgggcctgggacaaaggtggcctcacagccagcccaggcagggagatcggcagagaggggtggcccctgaccccagctcctctgccccagctgctgctccttggtggcggcccctcctgacaccaggcgtctgccatccttcaggcaccaaacagccccgtctacctggccctggtctgccctcacaccagtccacccccagccccaaccccaaccaccctccgctgccacggcctccagcacctgactccattcagggaactgaatttgagcttgcaggggtgagaaccacactgagcagcatgacaggctgtgagatcggaggagaagagtatatgctgaggctctcccagttgtcacttggtcttaggggtcctggtgcccgtggcgcggcagtccagccacagtgctgggcctgcacaatcagcctttaggtgaactggaacaggaagcggaacccccaaggcggccgagcagagtgggtactgggaggcatacacactgggcagcaacactggacatgtttccatacagaggctcctttggtgatgaagggaagaaggatcatgtgtgggaagtgtgagaaaggatgagtgtccgattcggtgacggggggcagggcggtcgcaggggagcaggcctcacagcggcggacagtgttcactgctggagggggtgatggcctcggggccaagtcagtaagagcttctgtcttcactggcaaccaaccgggggttatgggacttcttaatggcaagaggggtgggtgttttgaaagtgggtatttatttggatttatagtaattggcaaaattcagtccttggaggcgaaagtacctctcccagttaatgggcaaactggagaaagggcctcacctggaaactgtaggattcacattgtggacgctgtctgctaaagtgagcaccattaagaccattttctagctgcagctttcctggaaaacagcacaataatctcttaagtggctcctggtagctggcaagaccatgcggtgctccaaaaggaagttcaggcgagtgttcgctgtcggggtttgatccgtggatacagctgggaagcaacggagccgcgtcaggacaggaagccacacacagggagcagggccagccagacccgacccctgctcctcacctcagccaccctggacagccgtgcagcacccttgtccctcaggcctacgctcagctgcacctctacactgagacccacccagccctctttaaaatgtgccttgtacccccagaatatcctatttttctcacaacacttcatgccacctaaagacttgtgactgcctgtggctctcaaggtcataagctcccctgggcaagggtctctgcctggctccctgctgtgtttgcctggccaagaacgttggctcaacagcaagcccctggcagctctgcagggcacaaagagagcagaggcagctccctctgccagaggactgagggaatcacaagtccaacacagagctagcagcctgcacgttcccacctctccctccactggagaaatttctaggctgcagagatttctagattggggaaagtgtgggtgggctgagccgggccacttggtgaagttcatcatgaaccgagctcattgagcggcccctcactggggcactcagcctccgcacgggcctccatggcataagcatggctgggggaacctcctggggccctgcctgagcctcatgccagctctgccaagtaggcacctccccctctacagagggggctgctgaggctcagagaagcgaagcctccctccccagccccacagcaggataggaccgcatgctgtacagagacacgggcagctagtttcccagtaagtaacctgagtgctcacccccagcaggtttttgggcacatagccctcccggtctccaaggcgagcccaccaccactcagtctcgctttcgtccttgcgcctcaggatggtgagggcgtccccttcgtggaaggacagctcgtcactgttctgggcctcgtagtcccacagagcatacgccacacctttgttcatcacacccagcttttcctgcacccctggagccagagagcaatggtcaggcctcagcagagggtggcctgcagcaagggaccctgctcgaggaacaggacacagtcgtgctgctgccgaggctgctctcagcaggccccacagaggccagcgagggagatgagacactattgaagactagggcccccacccgatacctcccctgcccggcccagctgctgctcctgctgccggccctttctaagtcctgcaggacagacaggacaaacgagctcctgagccccagggcaagagtgtgctgttcttaaggtgacgcttagcaatcacagccagaacagatttctaaagtcactagctagagcagctgtgactgctcttggatggtaatgaacaaactacacacaactgagccctgactgagcagctacttgtgggttcccaagaaagggcccttctgtgggacactctgcttctgagacccagttgtggtgaccatggggagcttcccttccctgtggtggtgccactgtgacggcagcctcctcctcacactggcgggactcacctgggggctgctgtgcctcccctagccctgccacacagcctgagagtttgttgcttggctctgttgtgggagcttgggccaaagagggcatcacatggctgttttcatggataatttcaaacctagagtccagtgtagggcacatagtatgttctcaagtaatgtgtggaataaatgacttgtgactgtttaatactcagaatagagaagatgttccagctcttggaaaatgcggccctggctaaagcagcttaattaggacatgagcctcattcatcaaatgtttccggggaatggccagggccccaggccaccccaggaaaggagctggccctgcttccagaagcaagggtacagaacatctatgcaaagcacagccaagtcattttgttttcttgggaatctggcacagaatccttctaacaacatggactttcaaacatgttttcaggaatgaaaacaaggggcagtgtgaccttcactcgagtgagacatcctggctgcccctgaagaaggtggaacagctcgagaatgctgtgctgccaggcacggtggctcacacctgtgatcccagcactttaggaggctgaaagtgggcagatcgctggagcccagaagttcgagaccaccctgggcaacatggcgaaacactgtctctacaaaaaaaaaaaaaaagtacaaaaaattagctggctgtggtgggacaagcctgtagtcccagctacttgggaggctgaagtgggaggatcaattgagcccgggaggtcgaggctgcagtgagccatgattgcgacattgcactccagcctgggtgacagaatgagaccttgtctcctgtcttaaaaaaaacaaacagaaagctgtgctgaagcttctctggcaccggctgactgttgccatggcagtaccacagcagacagcaccactgtggccccaggcctcccctgcgtaccatatagaaactgggagcactggatgtagccttcctccatctcctcacacttgtctgcagcagtttcaatgtcgcttatggttgaggcaaaaatggcggcaccactctccaccagctgtttgcagaggtgaacgctgttacaagaggcagcgcagtgcagcggcgtcctggaatagagcgtgggtgaaggtgcaggcctggcactgcctgtcctgtaggacgtggccctcagagatttccctctaaggaatctcgcggaaggcgttcacctttgtgccatcaagtctcagtgttgtttctttaaaggcaggatttccatgagccaattgtttcagaccatacatacattttgaaaagggggcacagggaatgggttaagaaatggccaatccacagatgttcacgccacactgcatggtgatgtgaatgtacataacacactgaaacacacatttaaaaatagctaagatgtgaaattttatgttatgtgtattttaccacgattcaaatgcagcacaatgtcagctgtctgaaagttcaaaataacccccacaggagaccaacacgcctcgcccagcagcagagctcccgaaggcaaacggaatgaacaatgcgacaacctacatgcctgacccagggggatgctgaggctgcttttcacacggagcacagagtgtgaagagtccatacggaacatatgagaaggggaagatggaatgattcacagaatgcttagactgcaatgttaatgacgaggcacagaaagagcataaccacagccacgtttttaacaaaatcatcaagagaaaaggctggaaaaaaaggcaaggaaaccctggcaacagctgtctttcaaggatgaaatgatgggtgttcttgctctaattctctcttccgtgcttcctaattgtctagaacacgcctgttttccttatgcaaagcagggaaagtaaatctgtccaccccacactcctacgggcctcaccatccatcactatcagcagcattcacgttgacaccaaaatccagcaggaacttcacgatgtgatggtggccggcgcagacggcgttgtgcagtggggtgatcccttcgtcgttgggcttgctgggatcttccacctaggacacacggcctgtgagcgcccatcccctcgcccccagcagcgtgcactggtccccggctgcagctcacctcatagatgatcctctgcaccagatcgaactctccttccagagacgcgtctaggagcagtgccagggggttaaaccggactctcagcccgtgccccgtccgctccgagttgggcttcttcaagttggtccgcttgttctgttgggaaggaagcacgctttccagttaaaggtggtccactgaagtctaagaacccacgcctgctgggaaggagtggtgggagctaaagcccaaagacagtggctccgcgaagcagccctggagtggtagcagtagcagcgcccaggtgaccacctcaaataagggccagggccactctgctcactacaagggagagccctgtctgaggcctgagtccctggctcacgcacagagggacacggctgtgtttgagcttctggccactcctcggaagactctgtgggagggagggtggcgtgtgactgccaagtagctgatgggagccagcagctcgttcctgcccacatgcgacagggttcttcctgctatggcaccagatcctagtggagagaatcccactgagggttccctgagatggcgcctggctccctctctgctccgtcaacactgacctcccacccagggcctttgtctagatgcttcttccctcgtctctctacaggaccttcaggtgccagcgacagctccccttcctcaggaaagcctctggagctccctgaccagctgtctgggaaaggcttggccacattgtgcatttgtgtggccgagccccatttgtcatgccttttcatgccccatttgtctgtgtgactgtccgtcctccctacaagacgtaactcagggacatccctggttcccactgctcccagcacagcctgaccaagggaaggaccccagaggtcctggttgcatgaatgaccaggaaggccaggctttggtctagcaatgacacccaccgtggaggtggcaggagggtggctggcagggggaagaggtgctggagggacctgctcttcccctggagatggggcctcagccacaggactcgggatctgctccgtggtggggaccgtggccacgttgttgttattgtcctctgccggctcggcagtttggtgggtggtttggggacagatgagctcctctggttcgggggaaggtaactcattatcattggcatctgatgacggggcaggctcagcggggagtggggctgtgggctgggcaggggggagctcttccaggtttccattggcattggtgtttccattgtccacatcggccaaggtgcccatgaagtcctgggaggggctgggctggtagaaaggggtgccctccatgccaccggccagggtgttgaagcgctggtacagcagcttctggatgttgggcccgccggggccctcgggctctgtgatggagctgcgctttttcaggggccggggcgcgttggccagcttcctgcggagggcctccaggtctgcatcactctggtagcgcagtggcgaatgcacgatgggcgtgagcttggtggggctgagtggccgtggcaggctctccacggtgctgccatctgcgggggcggcggggccatcctgctcaggctctttctcagtactttctgaaggtggctgaggctgtggtgtgcccgtggacagtgacccgtgaagaaacggcagcggcgatggagaggttgaacccgaaggtaaaacgggcttaccatacactggggaagacacaaaggacaggcaattttgacctcactacagagatctagtcatacacacctatgattacaccagagacaggctcctgcaaagacacacatatacatctgctgctgttattcaattctcatttcaaatctctgaggaaacctccccctcttagagcctccactgactccttctgaaaggtgcagtgcctctctaatgtgtcggtttttacatttgggtttccagaactggagctttttcaaaagaaaaaaatagggtgctaacccgacttttcctgccgcagacaagcctgcctgttttctggccaaggaaaaagacaaaaaccactaaacatgcatctgattcttggactaactcacatgacggagacacacgcgcctcctcagagcaggaaggttttacctggaggtccaggagctcttgagaatggtctaagcctttcccaccacagccagaaccctccccacaagggaacactgcaccaccacctgggaggtccctgtgcaggaagtgactaggcacgtccaggaatccctcaactgtgagtctagaagctgcagccaatgcccaggaatgtctaagaaggccctagcctagacctgacccgcggcttcctcccgtaagagtcggaaacaccatcagcctctgtggtaggtgtggaactaagctaccttctctcagctgccttcttagaacatctgagctccataacccaaaccaaggctttcctcccctctgggctatgggggaggctcctacgcagcagacgccctccttaaactgcccatgcccaggggtcgggctcagccactaccaggagggccagtggtcaaggccaccctctacgcactggacagctcccggcacaagttaccacgaaacagaaggaaaagaggaaattctcgacatctcacccttcccggagctggatttcctaagtagcacacggaggtggctgctcagacaggaagtcagagaactgtgagccatctgcaaaacagcctcctccatgcattccagcttccattcccttctcacactgacacccaaggctgtacttttatgtaagaattaagtttaatcctaaatagcacgtggcccaaacgtaaagaaatacattagtattttcttaattaaaagtataatttcctagccccaagaaaaggagagtataaacccactctacctgctttaactgacttatttaaggcgctgtgtgctgccggctggtaattcttaggtggtgtggcttgctggaggtacatggagtatatggaacttgaattcactgtctggggtcctttcctgggagactgtggccttgaccctttatcagccaggaaaggcctaatggccactgtcagtgggagttcaggcttgctgtccccagctggaaatgcaggtggtcccgctggcgggtacgtgggacttggcggtacggaaatcctctgctgaatctgttgtgaggagcctggctggggggtgctgcctgtggcgggcagcagggtgggcctctgtcgacttggcaggcctgcactgggcctgggcaagctgccttccttcctcctttccagggagcttgtcgacccaggacccagaggtgtaggacttgggtatgtcccatagcttggaggcagctgcttgcctacacccgggatgggaggtggcactttaccaatctcgatgccctaagtttaggtgttaagaagaaaaacaaagtcaccctttgaacagttaagaatatttccacccacattcccaagagaatacacagtagaatttgtaatccgtcaaattggctgtgaccaggacttggggcacactgttgagctcattgcctgtctgcaaaagttctgaccgaaaggtgtgtgtactcgtgggctgctcaggctcttagggcccagtaaccctctaggactttgggtgttgtctggacaataacaggattaacttgcctcctgacaagtcataccctttagcttagtactaaggcagaagagagccctgttgaagagcccgcttgtgttctgtggtaaagacacaggcctaccggcttctccgtgggtcccagtgctgagaagggcacaggctggctggagacagtgccctgcttgacagacccctccacgctcggatccttccagtctgcaccggccacctgcactggtttcacggaagagctagaattctgttttaatgttggccagtttccatcattagcttgaaaagaacacagaacttacgtaaaacttttctcaatgtagttgaaccaacctaagaataacactctgccagaaacaaaaacagcactgggacatcccattctgatgcagatccattaaccgagtggtcaaccaccagccacatgcacaactgctgatctcctccagcacccacagacccgtgcacaagaccaagggacgggctctgctggcagctcactgccaacgcccaaatcgcctcaagtgttaccagagactcacgccaaaccaaggctccactggtgtgggcctggggctgcaccctattttaacacaggtcaaatccattgcatcagcaccaccaaacaaaataagcactggcccttacttttgaaacactatttatgaatacaattacatagagcaataaaaaagatttatcttttgacttcataataggtttgacctgtagtactttaattattgagataaaaatttctgccctctaaggtaacttatgatcacaggaggcccgtgcaggttcccactgatttgcgtagcaggaggagcaggctatcattctgttgcagtgattagaaagctggtcatcaaccccaagttttcaggaaagccactgaaatgacaggttctttacagagtattttccaaactgaaaaagggtgcagaagtatccccttgtaacacaaggcccctcacagtggccgaaagtccattataacacaggctcctggttctcttttacaggaacaggtgctgaactgaactaaagtgttcaacgcttccagcgccatcagcaatatgggacagacagaaatcagagggactcttttaggccctcctggcaggaacagcacatccccttcccttatcccatctgccagcacaggcaggaggggataactaagtagcagcaggaaaatcagtggtcctcacaacaacgtctgagccagaactccggactcatagcacatgacgaggaagcttcccggctgcgctctgagcgcctgggcaacacagggcccatcagccgcagcctcacacggcttgctcctaagccaaactgacccgatgcagccgcaccgcaaccccagctgcatacactgctgggctgtgaagttatgatgcaggctccaggcagcggcttctgagacagctctagtcaagccccgtgggtcctggcgaggcattccaaggcccctggaccaactgccatcttgctccacgtggcctggaggatgtgtggccagaaacctgcagcctccccaaggacagggcctgtggtctcagggtcacagggaatgtggctgtccaggtgcttcagaaaccacccagcaacaacaggaagttttatggaaatcagccatagtggggactaaaaagcaattttctcctttcttcagaagaaggcaagaggtacagaaggaaaatcattttatagaggaacaattatcttttagtatgattgtaaaactaaaagcctcataataaactcagaaatatcttaattttgtaaaaacaaacaaaaaaccctccaaaacaaaacccgcgctacgccagcatctgtcccttggtgtcacactctttctaaggatgggagggtacacgtggccccacccagactccatacctgtctgttgaagaaagggacaaattacgtttgtgtggcatctttttcaaatctagatgtgatgagcagacctttgtcagtttggaaaaacaagtgacaggtgattttgtacatattaaagaggacgcagcttcccactaagcttgtcagccaacatacggtttacaaatgggcttgcagagggccgcgaggagccataattaggcccgacgtcgaggtctgacactgtccatgagctggtcactctgggtttactgtggccatctgtgtgacacagaaccaggacagccaacagcaagggattagagtccctgccaggaggcttcacagcccagctccacctctgggctgagctgctgccccgactctgaaggtgagcacaggttccccgtgtccatgactttcatccacagcagaggctaggaccagggcttcgtgaaggcatctccttgctgcaaccccttgaggcagcacagcagacaccaacaaggacgggacacaggagacatttctcaccttggggagtttctcaaaggaagtcagcagagaagtagctggctgtgctaattacctcccactggaaacagacaaatatctactcctaccacagggtggttcaaactataaataacagcttagcagagcaacctgcagttaggggttcatgccaaccccacactttatgtggctgctgagacacggccgtaagggatctgagtgggggcttgtggctcacaagtgctggtgatgctcttctctttcggagttcataacaagacccaagctccccagtgggggcaacagatgtgtcgctgtccctcctgggggccaggcaagagaaaatgaagcaaacaaagatgagcacaaatccaccacaatcccgaaaaaggggctcgaaacacaggcctgatggccagagagtaacagtactgttttcataaacgaaggaatgtttcaatacatcaggacagggattcctgatgctgtgtgtttcagggaaatgtgtcaacctcagtcataaagaaagtcttattgcaaggaagccccaacacttttaatgcactggttgagaaacagactctccatgaacagcttgccctctgcttggcaggggcaccacccatggactacactagaggtccaagtccatcacacagcaccattgtgaggtcaagaccaaaccaacgatgtgtggactttgatcaatgaggacagagcgctgtttgtaggggcagcccctccacttggctggctgtagccgagttgtggtgaggcatccatgccgggcctcagtgtcctcagagtaaataaacctgcagtaagagaggacactcgtgggtcagttttttttgttttgttttgttttgttttttttgagatgaagtttcactcttgttgcccaggctgaagcacagtggcacgatctcactgcaacctccgcctcccaggttcaagtgattctcccgcttcagcctcctgagtagctgggattacaggtgcacgccaccacgcccggctaattttcgtagttttagtaaagacagggtttcaccatgttggccaggctggtcttgaactcctgacctcaggtgatccacccgccttggcctcccaaagtgctgggattacaggcgtgagccactgcacccggcccatggatcagagttttaattaatcatttgtgttttgaaaagccacacagtagagacctctagttcagtaaaaataacttgttttccttttaggattgttaccacaggggaacacagctctccaagcgcctcacggggagactgagcctggagtctgacgatgtgtggggcagagcctcaggagcctgccccaccccccgcccctccaccgcaggccccattccctgctcacaaactctcccccaggaagagggccaggaccactcaccggatttggatcttccatgagcagcatttgaggcaatactgagagactggggctttatagggtcccccagcacaggaaagcttccggcactgggaacctggatataaggccccacagcagcgaccctgcccgatgtgctcagaggggactgtggtgatgacgtgccattcacacggttcagctacaaattgggaagaaatgagagtcaagattctcctacattcaaagaagtcctaagcttagtgcaagagactgccagctcggacagaaagcactcactcagtggttggtttttaggaagcctgtcatctggaaagatcagcatctagaaggggagactgtggagaaggaactgtagcttcctatgagcaattctccgacaacacccacccatctggagctgtacacatgaggagctgatgtgagggcagagcaacttccccgtgatccacatgcagcttccctcttactcaggatactcttcctcccttgagtgggcacagagacactggtcaaatcctgggctctgagcctggcttcaaatcccctctgtgacttactcgctgtgctgcttcgggcaggtgactcagcctctgtgctcacacccgtggagtcgggataagggctgtagccggtactgtctaagccacgtggggcacagtgagcacgtaaggctctgactcccagcaatgggcccagttccctgaaggcagcgctgcctttctcagccaggacacagagccacagacagaggacactgttcacataacactgctcaggaacagaggcgcctggaacagggattctagagaactactgacgtcctcaagatttcaatataggctctaaataggatccataacccctgtgattgtaagattctatatgcatgaggacaggtcatttcggggtgaggggttatggctttcacaattgctcaaaggtacctaggacctttgggtggagacgcatctctgcaaaaatactgacttcttcaaggcgatcccttgaagtgtaggtggaatgaatctagctgtttgtgatggataactttacacatcaccttgactaggtcacagtaaccagatatttggccaaataccagacgacatgttgctgaaaaggtattttccagatgagattaactttttttttttaatttccataggtttttgggaaacaggtggtgtttggttacatgagtaagttatttagtggtgatttgtgagatttagtgcactctagcagtgcacactgcacacaatttgtagtcttttatccctcactcccttcccaccctttccccgagtccccaaagtcaactgtgtcattgttatgcctttgcatcctcatagcttagctcccacttatgagtgagaacatacaatgtttggttttccattcctgagttacttcacttagaataatagtctccaatctggaagagattaactttcaaattggtagatttgagtgaagcagatgaccctctagaaggtgggtgggccccatccaatcagtggaatgccttaagagaaacagagagacgccctgagaaagcgggatcctgcctagagttggccttcggactccagctgcaacatcctccctgggcctccacgctgccggccgccctcacagattctggacttgccaacgtccacaatcatgtgagccaattccttaaatcacatacacacacacacacacacacacacacacacacacacacacacacacacgtgcacgcgcacgctactggttctctttctctaggaagccctgactactacgccattactgaggagcatatgtaagcacagggaaagtgcttgcagcctctctctcacatggcctctttgttgttaatcttgagaaaaaggaaaaccaacatctgaaatcataaagttgtacaaataaactactgatctttaaactcactgtgttgtttttttaaaagaagggcagatttgtaaatgagagactgtgacatccacagaactggaagctcccttctacgtctaccaccctccacacccactccccctaggcaaaggccttcaagcccatgctgcctcctcagagcatctttcagagcagtagaggctaacaagaggacactattctgtcaccaaactatatgcagaagggagatgtgggaagggagtccttgctggtgggtcaggagagtgggtgctccattctcctaccacgagggcagaatgcactcagctctgcattcaggcactgctcccctaatcactgagtgccacaggtgcgagaaagtcaagtgccacatccggccaaagacacagagtgcaggcgcccctcctccatgcaggcggctcagtggtacatgtgctcaccaatgcactgtgagcagcagcaagactcaggactccctgcctgactacagagggtggtaaaggggtataggccctgggaccagggaatagctttcagatggtgcaaccagaatgaagtaacgacctggaaagacacccgtgctgcagttagaaaaagacaaggtgagcagtgagactagtgtaattcctgcaatcccattttcagttaaagttctgtacctttgtgtctttattagggaaaagactggaaccattagcaactatcacctctagagaacagggtggaaaggactttcacattttcccttaaatatttctgtacttaagagatttatcttaaggaatcgactcatgtgattgtggacgctggcaagtccaaaatctttgatactgaatttcaaaggttaatactcattttttcaatgagcatttattcaatgagtattttatcgtattattttttcattgagtatttattcaatgagtattttattgtattactttttcaatgagtatttactacctttaaaattcagtatcaaataaggattttttagaagcataaccccttacatagcattttggtcaagagtttacaaaatccttctacatggcttatttataagaatccttacaacaactcacggggcaggtaggacaaatcactttacagcaagaacatgaggctacgcaagtcaaagaatttgctcaaagtggcacagcttaaaatggcagagtgcggaccgtgacagatgctgtgactccagagccaacagcatcccccagtgaagaggagacagaaacacatggggaggaaggaaggccaggacactgagagcaaggctgcaggctgaggatggttctgcctccacacaccaggaaataaatgagtcactgggagaaggaactctgttctgtcatttttgatggtttatggcctatttatgttttatcagttatggtggatgggggagcatactgctacttacagaagatgggcaatgcttggataaactatctttagtagtttatctcacaaaaactttttcacatgcctgaatttttttcccatagagacgttcacgcagttcactgattcgcttgtccatcatggccacctccatgttgcgcttatttaagagttccttctgctgctgaagttttgaattttgttcctggttaagttggttacgaatctacaaaccacaaaatacaacctttatgatttgtgttaattaaaagtcaaattctcattgccagggagattaaaaaagaaaaagtagcattaagttctcatgtatatttacatgcatgcactgccaccttgtgtggaatatttcacaggtacagcagagataagccaggacagcgttctcatggaacaaagaaagagcaaacatctgtaagcatcttcttcaaagcacacgaaatgactagtgccaatgatgattacaggagactagtgcggtgtttgggactctcagaaactaaaggatgctctgctccaccccatggagctgcttcaggcctgagcccaccacatgatgcaccttactgtggaggcagcaggaaactcaaaaaggaccaaaaaggatggcctgagtcaccaagtgaagcacctttacatcattttagtggcttgcaaccagcattttaaagaaatgaactaggacagaacagaaaatatcagagtgtacttcccatagtaagagctgtcttaaactttcggatgcccacagcactagtacatacacacttccgtgtgtatactcaacaggacgtaaaatgtacttttaaaaactggattgcaggccgggtgcggtggctcacgcctgtaatcccagcactctgggaggccgaggtgggtggatcacctgaggtcaagagttcaagaccagcctggccaacatggtaaaaccctgtctctactaaaaatacaaaaattagccaggtgtggtggcatgtgcctataatcccagctactcgggaggctgaggcaggagaattgcttgaaaccaggaggcggtggttgcagtgagctgagattgccctactgcactccagccttggtgacagaggcagactctgtctcaaaaaacaaacaaacaaaaaacaacaataaaaactgggttgcaggctgggcgcagtggctcacgcctataatcccaatactttgggaggccaaggtaggcagatcacgaggtcaggagttcgagaccagcctggccaacatggtgaaactccgtctctaataaaaatacaaaaattagccaggtatggtggcgggtgcctgtaatcccagctactggggaggctgaggcaggagaatcgcttgaaccctggaggcagaggttgcagtgagccgagatcgtgccactgcactccagccttggactccgtctcaaaaaaaagaaaaacaaaacaacaacaacaaaaacaaacaaacaaaaacctggactgcagtccaaaaagttggaaataaatgacatccttatattacactcatcacatttcaccaaaaaatccttaaaacgctgcacttttaacaatcgcttaaaatgtagaagtcatgaaaccttataatactgtagtacttctatgcatttacgttaaagaacttaacagcaaccacaagtgattttactctatgtagttaaataccctcatttcataaaatgatgtaatattttttctagcaagtgctaataaagcagcaagacctatttctggcttgaaaaatcgcctgctgaatgacaacttctgagacatgaaaatcttaaggattgttaaggactgaatgtgtcccccaaaatctctatgttgaagccctaaccccattgtaatggtgtctggaggcagggtctttaggaggtaattaggtttaagcaaggtcatgagggtggggccccccatgatgaagttcacggagagagactacaactctctctccactacgtggggacacagcgagaaggcggctctctgcaagccagggagtgaacattcactggaaactgaatttgctggcaccttgatcttggacttccagcctccagaacagtgggaaataaatgtctatagtttaagccatccagcctatgatattttgttatagcagtctgagctaagacaaagatttaacaataggcacctagctcatcaaaagagtttacacaaaggccttaaaatatcaccctaagtttaattctttactggattattatctgctaattgaattattttgtgctgaaaacatcctaagtgaaagaagccggtcacaaaggaccgcatacagggtgtgttttggttaatatcctttaaccaaaatgctggggacccggagcatttcagatgttggattcattcagatttttaaatatttatgttatatttacctgtttagcatccttcctaatctggaaatccaaaatccaaaatgctccaatgagcatgtatttcctttgcatgccacgctggagctcaggaagtttcagatttgaagcattttagattatcggattaaggatgctcaacctgtactgcatgattccattcatatgaaacgtccagaataggcaaatctacagagacagaaagtagatctgtggctgccaggctctggagggtatggaggttgtggggtgatggctaagaggtgcgggccttttttttgggtgataaaaatgttctaaaattaactgtggcggtggatgtaactgacaagtcggtgaaggtactgaagccactgaattgtatccttgaaatggatgaattgtacgctgtgtgaattagatccttttttttttttttttttgagacagagtctcactctgtcacccaggctggagtgcagtggcgcaatcttggcttactgcagcttctgcctcccgggttcaagtgattcttctgcctcagcctcccaagtggctgagactacgggcatgcgccaccacgcccagctaatttttctatttttagtagagacggggtttcaccatattggccaggctggtctcaaactcctgatcttgtgatctgcccgcctcggcttcccaaagtgctgggattataggcgtgagctaccgcacccggcctatcccaagtcatttaaaaaattattttgtactgaatatatcttgtgcctattattaaattagaatctactaatttgtttccacttcctaaggtttccaacccatgctaatgaaagatagaaagatgagaatgttttaatacaaccattgccagacccaggagttacctgtagttcttggtacagtctttttaactccaccgccgctggtcccgtcaatttgccattgtaagactggaacccattcagttttcctttctttaaatcttccaattgctgactaagctgatcaacccttaaaattgcagtctgtacttcctgcttcttttcctggaacatggcactgaacctttctatttcagcagctataattgaccacacaagaaaagaataaaagatttagttgatcctttttttttttcatttctatacactgaacttaattctagtatcatttagtgccagaccgtggagaaagctgtgatatgcagaatccacaacacatttcaaaaagcctttgggacacatgtatctgattactcataaagcaaacaattatatttgcattaattcccgactattctttagggtaatcagtccataagctagtttgttcaagtgacttagaaatctctgagaccaaaggttttgtgaaggcagggccatccaagcctctctcgtgcatcactgtgacttaaagtaggcacagactgaaccaatgaataaaataagagttcatacagaaaaaaagtgagcatcagcataacttatcttaatgcacggatacaagttaagttattcaagaaaaacagaccctctgaatgagtaagtcttggagcgccccaccctaatccaaagggccgctggtaccaacgtaacaagaggatttttctactgcgtctgagggccgcaagagatctttttatttttttttgagacagggtctcattgtcattcaggctggggagcactggccggatcgtggcttactgcagccttgacctcccaggctcaagcaatcctcccacctcagcctctcaagtagctgggactacacaattttaagatcacttaacctaacccacccatccttttagatgcaaataacagagcaaaacttgagcacgcttgctatttagtcctgtgaatttgtgactgaattgtcaggcagttagactatgtttcactggatctgggcctggtgagagtggtgtcgagggggtgttgcaggcacgtacacagattgccgttcatgattttgctgtagtcgacttgtcctctcattgcacgaattttcttcagcttgttctcctgggcttcaactcgttctttcaatttctgaagcttttcattttcagaaatagactgctgctgacggcgctcctgttgctttagaaaatgtaaacgctgttcctaacaaaagaaagaaaaatgtaactttgaaaattgaaggctgggcgcggtggctcacatctgtaattccagcactttgagaggctgaggtaggtggatcacctgaggtcaggagttcgagaccagcctggccaacatggtgaaaccctgtctctactaaaaatacacaaagtaactgggcgtggtgtgcgcctgtagtcccagctacttgggaggctgaggcagaagaatcgcttgaaaccaggagatggaggttgcagtgagctgagatcgtgccactgcactccagcctgggtgccagagtgagactcagtctcaaaaaaaaaaaaaaaaaaaaaaaaattgaaacttatgattacttttatatactcaaaaagaaaaatgtgagagtattctacagtatcactcatcttaaagaatactaaaacactagaggaatcttatatcagaccataaaaaactgaaattactgggcgtacctaagtatgaaatagtaagagctgcgggatttttaagagagagggttttctttttcttcttttttttttcttttgagacggagtctcgctctgttgcccaggctggagtgcagtggcatgatctcggctcactgcaagctctgcctcccgggttcacaccattctcctgactcagtctaccgagtagctgggactacaggcgcccaccaccatgcccagctaatttttttgtatttttttagtagagacagggtttcactgtgttagccaggatggtctcgatctcctgacctcgtgatccacccgcctcggcctcccaaagtgctgggattacaggcgtgagccaccgcgcccggtgagagagggttttattacactcatctacaccagttaatataagcgcttctgcagaaaaccttccagcaggagaacatgcactaacacagtctcctcttcactctatcacatccgtgatgttccagtgagccttactttcctggtgcaagtaatacatttcctgctgctacaaagtggcttccaagaatctaattcatttcctaaaggaaatgaacactgaccagcagagaattttacactgaaaagagataaaggtgatcagtaaagagataaatcttcaatttgttgtgatactgaacaatcaaggaagtgtctgcttcttcaggattattttcttcaataaggaaacattttagagtcaaacaataccagaacaatctaaaaataacaatatatgcaacattcttcaatagggttttccctattaatgtgaaaacataccttaaagagtcaacattaagtattcatgatcccatatgtatgcataaaatacacctacatagggagaggtttaaggtgtgattatgaaggcactacatactacactctaaggtaaaacaatatgtgcttaaatatttaagatgtagcattaacttgtgattcacattactgaaaatatctataactattttgaacagcaatactcttggatcaatatttggaaaaaaataaaaagcagaattagaaaatttttacaatgacataatactatgtatattttatcttagaaatcttattaatgggataaagtactttccaattgaacttaacttttaatcattttctcataaatccaataaatattgagacaactttttaaaacaagtccaacccaaattattatttacataaaagtggatagtacaatgaagtatatacagtcattcaataaattttaaaaaatcagattggacattttagtcataaagaaaatctctctacagaagaaagcaataagaacctagttggtaatgtttaaatgttatctttaaagccagtttggaatttttttttctttttttttttcattttgagacagagtcttgctctgtcacccaggctgcagtgcaatggcgcgatctcagctcactgcaacctccaccgccggcttcaagagattctcctgctcagcctgagtggctgggattacaggcgttagccactacatctggctaatttttgtatttttagtatagacagggtttcaccatgttggccaggctggtctcgaactcctgacctcagatgatccacctgcctcggcctcccaaagtgctgggattacaggtataagccaccacgcccggccagtttcagaatattttaagatcatttacaacatgaatcatttccagcaggcatgtgtgatacatctgatgtttcaattaaatatgactaaaccattacttagaaagattcgagtttcaataaccagtgtagaactcagtatatataataagcattatctatactccgcactgtaataaaccaaacaagtccagcctagagtagcacatggggaagccccgttaaccacctgtcattgtcttcgtggccctgatcagtgttttcatcacggattgctgctttcttcttgaacattaataccaatgacacagccaagaacatacccagaggcaaaaggagataacaaaagcaccctttcttcccgatttctttgttttttttttcttttgagatggagtctcgctctgttgctcaggctagagtgcagtggcacaatctcggctcactgcaagctctgcctcctgggttcacaccattctcccgcctgagcctcccgagtagctgggactacaggcgcccgccaccaagcctgggtaattttttttaaatatttttagtagagacggagtttcaccatgttagccaggatggcctcaatctcctgaccttgtgagccgcccactttggcctcccaaagtgctgggattacaggagtgagccactgcacccagcctttttttttttttttaatacagggtctcacttactctgtcacccaggctggaatgcagtggcatgatcttggctcactgcaaccaactcctgggctcaagtgatcctcctgccttaacctcccatgtagctgggaccacagccacatgccaccatgcctaatttttactttttgtagagacagggtctcactatgtttcccaggctggtcctgaactcctgggctccagcaatcctcctgccttggcctcccagagtgctgggattacaggcaggagccactgtgcctggcccctttccaaattttatctatgattttaataaggtcatcagtttcctgtttggggtgtctattgtatgtgtcaaaagtgagatgctcttgttctgatagcttcccaacttccagaaactacagtatgcatatattattatggaagtgataacaaagagagaaagactgcatttagcactcctatggcatggtcctattttataagcgttacccaagaatatattaaccccagtctaaaatgatggttaaagaaggtactttttgaacaatgtttcaatacctctttttataacttaccttggcaaccaacatctgctgctgattttcaatctgctgctgttgcctagctgccatatcttggagctctgagagggtaagttcaacacgtggattcccaacctaaacaaaaagcacttattttggaacataagtttatctgcataattgtctgtctctagtgtcaaaactcacacatatcaggactttagataggatccctagtagtgaggagagtaccaactagtttattttcttgtaagaacttttcctaattgttgactgcttttatgaaatataaataactgtttttctaatgcataaacatcagataccgtatttagtaagggctcaagtttaagcaaacatttgcaaatgtgtattatgagtgacattcctccttctggaatgacaatttagtaggtatatttgagcaaatggggctgtcaaatgtttaaggatacacaaccaaaaatataaatatgcaggtaacgcctaagaacaaatgtcatctcactatcacctgatctcaggaaatgaaaatacgtaacagattctaatatatgaataactcactaaaaacaccatatgcatgacttacatgaagaacacatcatccgagagaattacatatgtgaaatcaacatgcaaagtaacatctagatgaatgcagttggctgtttctccattctccaatctctgtcaatgatgccctgaactaaacactttacatatatgacccatttcggcctcagaatgaccaatgaggtgggtactgttacatccctgttttacagataagaaaacaagcacagggcagtcagcttgcgaggcaaagcagagacacagagtctatgttctcgactgttcctcacagttcattacttactaagcccacaccacgtgcactgtgtactgtgacagacatgctatgagcattgtgccatatgctcttcaaaacaaatctgcatggggttgtgggggttatgtgagcccccactctgggtgaggagctatgggggtgaggggaaggagcatgcctagaggcacgcagctcattaaagccctagagctccattctcacaagcccatctccaaacccttcagttctgagcagggaggccacacagttcctcctcaagctcccacgttctacttctaggttcatatatactcttaggataccttcaccttctgccacccttaaacctcttataattcttaatagtcagttacagttcctgttcctccagctccatgtcttcccaaacttttatgatgtttgagcacattcttgactcttgaaacatgggatcaggatttaacagtctttttttttttttttcttgagacggagtctcgctctgtcacccaggctggagtgcagtggtgtgatcttagctcactgcaacctccgcctcctgggctcaagcaattctcctgcctcagtctcccgaatagctgggactacaggtgcccaccaccacacccggctaatttttgttatttttagtagggacagggtttcaccatattggccaggctggtcttgaactcctgacctcgtgatctgcctgccttggcctcccaaagtgctgggattacaggcatgagccaccgcgcccggctggatttaacagtcttaactggaaccaccattctgtttatctaaaaatcctgaaaaagcaatacggtacaagattttttttttttttttttttaatttagagactgaatctcactctgtcacccaggctggggtacagtggtgcaatcactgcagccttaagctatcctctcgcctagctaggactacaggcacaagccaccatgcctggctgatttttaaaattttttgtagaggcaggggtctcaccatgttgcctgtgctggcctcaatctcctgggctcaaatgatcctcccacctaggcctcccaaagcgctgggattacaggtgtaagccactgtgcccagacttaaacactttttgactagagtaaaactatgtctattcaacaaatctttcaattaacattaattttataatttcacaacttgaagaaaaaaaaaaatcaaaaactacctttctggtctcccccaccaaaggcttcacaaaacaatgaaaagaggatagaagagaaatttaactgtctggtgttctgatgtttatatctatgaataagatagagcttattaaaatattttacttacctaaaccaaaaagtattttatttgccaatacatacatttatactctttatgttgcgtgtgtttttctaagtacaaaattaagatacgccatcttgtcataggtaattcattgtatcttatacatcaacttataatgtaatgaaattttatggaagatcttacatatagaaaggtgtaataaatcattatgtacagctgaatgaattatttcaaagtgaatatgcctgtgtgatttaattgtatttaaatgggttataaaaacataagctaccataaacctgtaagtcaacaaatatgtaacaatttacatttcagtaattgtgcaatgtgaaaatttgggaaaaaagaagcactttttccacaatttcaaagaaaatgaaaactcttcaatgcaaactggattttttaataataggcctatcactgtattacatgcaaactatccctacttacaattttaaattttttatacaaactcaatttattcaaacaaacctattacctaattcttccctatttctcttcattgattgcatctaataagaagaagtcaaaccctgttccctcaggcaattcaaggtccctaattatggtagagttgtcggatgagttcagctccaggtcacacagtgcacaagccacttccaacaactaagttaaattagcagaaaagttttctcagcaacagtcaggcaggtgcctacaaatacgggacccccaaaaaggaaacatcccaccagccttaaacctgctccgatgatcccttcggcagggactaccacctgtggccccagggatccagatctcctccaacaccgatgttcactacctgaactctgggttccaggaacactgtttctgctactcatgaacccagctcactctccagcctcacggcaacatcacttgttttccacaataaacacggcccaccccgcctcaggtctagctagcctcccaccctgaccccagcatgagcagagggaaatagtttttattatcacttatctgatcatatcactgccttctttctccaaacttccacaaatctacttgcagaaataagagacttcattagctggcttacaaaatttttataaacaaaatatttgtctctccaaatattagtaataaggctagtcttacattctatttaatgtactattgaaatattttgctaatatgtggccacgcatgatggctcacggctataatcccagttcatgagtttcagaccagcctggacaacacggtgaaacctcatcactacaaaatacacaaaaattagccaggaatggtagcgggcacctgtagtcccagttacttgggaggatgaggtggaaggaacgcttgagcctgggaggttgagaatgcagtgagctgtgactgcaccactgcactccagcctagggaacagagcaagaccctatatttaaaaaaaaaaaaaaaaaaaaaaaaagaattttgctatgtgccaaaaagtagtaaagactacaattttacctatgaacagaggaattcatcatattacataccttatccaatacctgtccagttaatgactcttcattattgcagttcttgaaaaactatgccatttctttttcgtataattagtctttcacctagaagcactacataggccgggcgctgtggctcacacctgtaatcccagcgctttgggaggccaaggtgggcggatcacgaggtcaggagttcaagaccagcctggccaacatggtgaaacactgtctctactaaaaatacaaaaaattagccgggcatggtggcaggtgcctgtaatcccagctactcgggaggctgaggcaggataatcgcttgaacccaggaggcggaagttgcagtgagccaagaccgtgccactgcactccagcctgggcaacagagcaagactccatctcaaaaaaaaaaaaagaaaaagaaaaaaaaagaaacactaaataatgctctataaggagtggtattttgacattacaatttcaggcaaatatacatactaatttagtcaacccaattgttcctagtcagagaacagactctggtacagatttgaattttgtgtcatgcttggataaacccaaaatattctgcttttgcttggcatacatatgccaagtgcctcagaggcaggggagcatcttcgacgcctgttttgttgtgcacatgtgctggctctacctgctctgaagtgctctcttgtttagcttttgtgaccctgaagtgctttcctgtcctataactttatttttattataagttcagtcacagtgcaatctccccaaacagcatcatcataacccagagaagagagagaacatgtatatgtttaaaggagctaagctacagcataaacgatggaggtttaactatgaatggtgctttttccttcaatgcctaacatacattcctttgtgattacaaaatcagttaatagaaaagactagtggattttgtcagcaattaaacatctactggcaaatgggtcacttcagatgtccctaatcttgatatgctgattttaatattcagccaaattacttcattatggttataataggcaagaacatctcacatcggggtctgttgtggggtggggggaggggagagggacagcattaggagatacacctaatgttaaatgacgagttaatgggtgcagcacaccaacatggcacatgtatacatacgtaacaaacctgcatgttgtgcacatgtaccctaaaacttaaagtattaaaaaaaaaaaaaaagaatgtcaccataataatatttggaataggcagccactgctgcagcctctggaagcctgaaaaacgggaaccaagagcaagagaacgactcagtccctgggtgtcggcggtggccgtgggggtgagacggatgggggtggaggcgctgctgctgtgggggcaggtggtggcggcggccgcccgctccagccatgctgaataaaaacaggaaggagaaagaatcaccaaaagcagggaagagtggaaaaagttcaaaagaaggacaagacacagtggaatcagagcaaatttccatcaggacaaacagccttgttgctgtccccgtctacagtatctgctaaataaaagtaccagcctctcagcccatagtgaagaaagacaaacggcaaaattcttcaaggtttagtgcaagcaataatagagaacttcaaaaactaccatccttaaaagattcgttgtcaccagcactttgtgaaggttcctggggtggcctgcagcagcttttcccgcagctccctcacactgccaccttatgacagggataatgagatggacccggatttcagaaacaataaaatgtggaatgtgtccatgaaatagggttgaaaggttgacttggaactcagtgggcctgttgcttttctctatgaaacgtctgtagcttcttagcacagtgcgtccatttagaaaggggggtctgttaactagtacatggtcattgtttaatgcaccttttaatctcttccttatcagtggcggttatgtctccttataagttcatttattcttttgactgttctgtttgtgttcagtattattcatctgtacttttatctttaattatcctatgtcttttattttaaccttttcttcatttattaagttgaatagagagttgacttatttttagtttgctttttaataataaaagaatttaaagccacgtattcattctgagtataactttcagccctatccctagattttattttttccttaacttttcgagtcacaggcttttcttttttagagttaactgaggcataatttacatatcctaaaattcacccattgtaactggaaaatttagttattttagcaaatacatagagttgtgcaaccatcaccacaactctgttttagaatgtttccatctgcctccaaaagttacctcatgccattcaccattaatttccactctgggccccagctgcaggcacccactgatctgctttctgtctctagacttactttcttccggacgcttcatataagtgaagtcataccataggtagtctttcacacctgctgtgaggtttttgaggttcatctgtgttgagtggtttctttttaatgctgcatcatattcagtcagatggatacaccacaatttgtttatccattcaccagttaatggacatttgggctatttcttagctggtatgagtaacagtgctgctgtgcacatttgcatagaagtctgtgcgagcagatatttcatttctcttgagtagatacctaggagtggaattcctggcttgtatggtgagtttatgtttagctttttaaaagactgccaaactgttctccaaagcgattgcactattttacatttccaccagcaatggacaccagtgtgtccacattcttgctaatatttgtctttttgcttatagcttaattcttgtggatgtgtaatggtgtctcactgtggtttcaatttgcgtttccccaatgactggaaatgttaagcatcttttcatatgcctgttagccacttgtctctcttctttgatgagatgtctatttttaagttggttgtcttcttcttgttgaattgtaacagtatgttatcccagatatgagtcctttatcagaaaatacaatgaaaataaattattatagaagtacaaaatacatccacaatgttaattattgtagtcagtagacataaaattaccctgttaagttgatatgaaagtttcaaaatgcttattctcaatttctgttattcattgcaaatcttcagatttgtctatatgtgttaaacatttcttttgagcttttaatttcagggtttttttttcatttgtgaaagttctgtttggttcctttttcggtctgcagtgccattttaaaatattttcctattctcttgaacataccaacaaaacttgtcatttatttaaataaagtaaatacagctgtttttttttgttgttgtttgagatggagtctcgctctgtcgcccaggctggactgcagtggcggatctcggctcactgcaagctctgcctcccgggttcatgccattctcctgcctcaatctcccgagtagctgggactacagacgcccgccaccacgcccggctaatcttttgtatttttagtagagatggggtttcaccgtgttagccaggatggtctcgatctcctgacctcgtgatccgcccgcctcggcctcccagagtgctgggattataggcgtgagccactgtgcccggccaacacagctgttctatagcctgtgtcaggtcataccagtatctgaggtgtttgtcacattttgttcgtgatgtcttatttccttgtgcacgtgatttttaaaaattgtatactggtcattgtattcagattatttgaaataaactgtaacctagaatcaaaaaaatatatattatttggaataaaaaattccctaagctttcaagctccagtgagatgacatgaaatagttcaacagtttcatgctcgttcctttttgcacttagtttataggagaacacaccttgccaaaacatccacttctggcctctctccaccaaactcctctctctccttccaagcctggcttcctccctaaattccctatttctatgaatggctctcgcctttttccagaagcctcagcagcaacatctttgattgagccatccttgccctaaataaaggctgctgctcgaaagtgctcttcatgacctcccacatctgtgcttgccactccgttctagaaccaacactttcctgtgagcatatttcactcatgctcttcccgctgcccacagtgcccttcccccactgcttcctaaactctgcctatcacttaagacctaggaggcaatgccatctgcttcctgaagttcttcctgattctttaaggactctctcataccattgttttgatattcaggatgtttattcactttcagagatgggaagaactcagtactttttaaaatgaattcttgaattcattctagagattcagcaattaacatgtaatgaatgcctgctgcatatcagacatttacatatacccaagtttacagttgtcttagatgatgcttacaaaaactctcggaggaaatttttattttattattattattattattattattattattattattttgagacggagtctagctctgtcgcccaggcttgagcgcagtggcgccatctcggctcactgcaacctccacctcctgggttcaagcgattctcctgcctcagcctcccgaatagctgggaccacagacgtatgccaccatgcccagctaattttttgtatttttagtagagatggggtttcaccatgttatccaggatggtcttgatctcctgacctcatgatccacccacctcggcttcccaaggtgctgggattacaggcgtcatccaccgtgcctggcccctaggaggaaaattcttaagcttattttataggtgagaaagctaaggctctgggcagctggttgactggctttcccacgcttaagtgtcaggtcagtagcagtgccaggatcctagccacatctcctgacagcaagcaggcactctttccatcacatgggaggtgatgccctcaccacctggctgcagcttggtatccgtggttgctcctaatcaacagccatttattatgtcaaagggtaaacacgctaccagacaccatgaagacatcttaataatctaaatcatatgaaaatactgcttttttgtttgtttttttcagacaagagtctcgctctgtcaccagctagagtgcagtggcgctatctcagctcactgcaacttccgcctcctgggttcaagcgattctcctgcctcagcctcccaagtagctggcactacaagtgcgtgccatcacgcccagctaatttttgtatttttagtagagatgggtttcaccatgttggccaggatggtctcgatctcttgacctcatgatccgccagatcaaaaaatgatcaaacatcaacaatttcacatagttcgaactaatgggaaaggattaatttctcccccttgaaaaacataaaagttacttgattcaagaataaaacaattttaaaactaagataaaggcaataatgagaactctataggcaactctttatttttggaagattatgagaagtgaccaaatagacctaatgtcacctgcccaatgacccgaagggctttggagtggaaggatcacttgaggccaaaagttcaaagccagcctgggcaacatatgagacaccatctctacaaaaaaatttaaaaattgctgggcatggtggtgcacacctctagtaccagctactttggaggctgaggtgagaggactgcttgagcccggggttccaagctgcagtgaactatgattgcaccactgtactccagcctaggcaacagagcgaaaccctgtctctttaaaataaataaataagaactgaaaatctataaattaccatttagaagaaaaactggatgccttttctgcttgtatcaccatacccttgaaactgtattttcaaatacttcctttgaaagtctctgagattccaggagttgtgacaccattgcaaagcacagcaaacaatgacctcacaaggctcgtctccagtctcattcccgtcctgctctttatctcccactgctgatatataattcttgcaggccagcaccacagagatctttctaaaacacagcttgcttaaaatcccacaagattaatctgagctcttagcatggtgaagacctggcctctcccaggctggtcctcttgctctcgctctcctccctctccgtgtcccctctcagtgtctcctcccccttgcctgtccctacacttcatgctgcacagtcctgtttataactctctgtcaccatacagtttcatgtctattcctctgtatctttgtggaatcctctgattctttcttttgggaagtattgcccaacatcaatcttgataaagttaatcatacccctttattttggtgccttattccacttttactacacttttcatactagcatgatttgttcacacatctgtctccaaaaatgccctttctttctctataaaatctgagaggagacttcaggtggcctccactaaccatcttgcttttgtgtctttattctgtctacaattaaaataagttgcatagaattgttttaaaaataatagagaaattctaagcctccgtggtagtcacctgagtgtcttcttttttttttttttgagatggagtctcactctgtcacccaggctggagtgcagtggcacaatctcggttcactgcaacctccgccccccggggttcaagtgattctcctgcctcagcctcccggatagctgggattacaggcacccatcaccacgcccagctaatttttgtatttttattattattattattttttgagatggagtcttgctctgtcgccaggctggagtgcaagtggtgccatcttggctcactgcaacctccgcctcccaggttcaagcaattcccctgcctcagcctctcgagtagctggaactacaggcgtgcgccaccacgcccggctaattttttttgtattttagtagagacagggtttcaccatattggccaggatggtctcaatctcctgaccttgtgatccgcctgcctcagcctcccaaagtgctgggattacaggcgtgagccactgcaccaggcctaatttttgtatttttagtagcgacagggtttcaccatattggccaggatagtctcaatctcctgaccttgtgatctgcctgcctgcctcagcctcccaaagtgctgggattacaggcatgagccactgcaccaggcctaatttttgtatttttaggagagatggggtttcaccatgctggccaggctggtctcaagctcctgacttcactgatccaccctccttggcctcccaaagtgcaggattacaggtgtgagccaccctgcccagctctcagtatctctttaaactgtacatgttttatacatgtacatatatttctgtgtatatatttcacaataaagaatagaaaaaaattagaccaaatgtctagtatcttatcttgtaatttaatcatcacaagatttaaaaagactataaatatttttagcagtttacagaaaatgtctttaaatttgtctttgttttacttccacactgcactgatcttttttctttctgttttttgagatggagtctcgctctgtcacccaggctggagtgcagtggtgcgatcttggctcaccgcaacctgtgcctcctgggttcaagcaattctcctgcttaagcctcccgagtagctgggatcacaggtgcgtgccaccatgccaggctaatatttgtattttttttttagtagagacggggctttaccatgttggccaggcttgtctcaaactcctggcctcaagtgatctgcccgcctcagcctcccaaagtgctgggattacaggtgtgggccactgtgcttggcctacactgatgtattttaaaattttttttttgtagagacagtgtctcactatgttacccaggctggtctcaaactcctagtctcaagttattctcttgccttggcctctcaaagtgctgggatcacaggcgtgagccacaacacatactgtataactagttttttttaaaagtataagcagtttctcaagtaaaatgtcatttcaaaaatgacaaacatccctaatgcaaaactctagcaaaataattagaataaaacctacttatgctcacgtaatattcatcagtatgaaatcattcctctttgttcctatctcttcaaggttatatatcttctggtttgaagagtaggttttacttgcccatttagcaaacaaaaaataggtgataatgatatcaagataccttatgaacacggatgctcatttttatcacataaattatatgctcagtattcccagtcacaaaggtggcaaaaatataaaatgttcaataaaatcaagcctctctaacatctcattaaattctgaagccagaatatttcatattccaataattactaagtctcacaaattaataagagccaattagatatctaaaatgcatactagctccctatcccctgcaatagtactacaacatgctattttagtctataaatgtgaataacttttttttttttttaaacagaaatgaggtctactctgttgtccagactggtctcaaactcctgatctcaagtgatccacctacctcggcctcccaaagtgctgggtttacaggtgtgagccaccacgcccggcccaatatgaataaattttaatcataagacttattcacataaggcccaggtggtagctcatgcctgtaataccagaactttgagagactgaggcaggaggatcactcgagctcaggagttcgagaccagcctggccaacatggtgaaaccctgttctccactaaaaatacaaaaattagccaggcgtggtggcgcatgcctgtagtcccagctacgtgggaggctgaggcaggagaattacttgaacctgggaggcagaggttgcagtgagtcgagattgtgccactgcactccagcctgagagacacagcaagacactgtcttaaaaaaaaaaaaattcatccatatccattcaattcaatacacatttatacccaaggcaagatgctaggaataattagggctagaaagaaactggcaggaaaatgggctatcaaagtgcacagataacaacagaaaacgcatcccatgccacatgagaactatgacaacaccctgggagcgctctgcttccaacctcatggctgacaggacaccctgtatcacactcctggtaacaacacctaaaaggcaagataaaacacaaaacatgtttttaaaagcatcactgagttggcacaacagtaaggaaactacagggaccaaaaataaagagaaaccagaaaccttgggcaataataaaagaactccacagctggcttttgtcctgaaggtttttgcccacctgcatacttgctccctggcagctggtgaagtctggcattaggaggtaaagacttaagctcattccattgtggagagtccaagaggagatgcccacaaacgtccaggatgcgaagacctacaacctcaatgtaaggctaactatgaaatgaaccccccaacagaagggggcagtaaggaacctacctttctctatcactgagtggaaggagagacggccccctaactatctgtaaccactagacagctctcatgaaagcgtcatgatccacaaaaggacagtagaaattgagcctagcttgtgcctagttactgacaaaggcctttcaggaaaggcctgactttatccaggtgtcaaaaaatgcccagaggtaaagttccaaggaaaacgagcagctcattgtcaaaaaccaaaacacagagcaatcaaggagccaggactcaacagtcagcagaagtcacgttcagattgagaaattattagttgctgaacataaaatatgtttagtgtgtttaaaatgtaaccaaagagcaactaagaagatttaagaactaacacttcttttttttttttttttttttttgagatgaagtctccctcttgtcccccaggctggagtgcgatggcgtgatctcagctcactgcaacctccgccccctgggttcaagcgattctcctgcctcatccccctgagtagttgggattacaggcgcctgccaggacgccaggctaatttttgtatttttagtagagatggggtttcaccatgttggccaggctagtctagaactcctgacctcaggtgacccacccaccttggcctcccaaagtactgggattacaggtgtgagccactgtgcccggcctaaaacttctagaagtgaaaattttaatgaattttacaacagctttactgaggtataattcacatataataaactgcatatatctaaagtacacaatttaatgttttgacaaatgtataaactatgaaatcagcacaatcaagaaaataaatccatcctctccccaaatttccttgtgcccttttgtaatcccttcctcctatctctttgccccccactcctggttctcatatccacaggcaaacactgaccttccctgttactagagattatgttttctagaattgtatatgaatgaaaccataacagtattcagtatgtaatcctttggctggcttctttcagcacaatgattttgagattcatccatgttgtagcatgtattagtagttcatttcttctgattgttcaggaatattccactgtgaggatataccatagtctatttgtgcatttatctgttaacgaacatttgggttgttgccagattttggcttcaagccaaatcaaactgctatggacagccatgtacaagtctgcacagacatttgcttccatttctctaaggtaaatatttaagagtagagttgttgggtcatacagtagatttatgtttaagtttcaaactaccaaattattttccagattataccattttacattcccacaagcaatacataagagttccaatttctccctttcctcaccaacacttgttatgatcagtctttttaacattagacattctaataggtgtgtaatgccacttcatggtggttttaatttgtattttcctaaagactaatgatggtgaacacctttccatgtgcttacttgacattcatatattttatttggggaagcacctgttcaatctttcacctgtttctttttctttttttttttttttgagacagagtcttactctgttgcccaggctagagtgcagtggcgcgatctcagctcactgcaacctccacctcccaagttcaagtgattctcctgcctcccaagtagttgggattacaggcgtgcacaaccatgctgggctaatttttgtatttttagtagagacagggtttcgccatgttggccaggctggtctcgaactcctgacttcaagtgatccacccgcctcagcctcccaaagtgctgggattacaggcatgagccattgagctcggcctatttcttttttgaattgggttgtttgttttcttattattaagctttgggagttctttatatattctgcatctgaatcctttatcaggtacatgatttgctagtatttttcctagactatgtcatacctttcaaaataataataataaaagcaccttttatgtattaaatagacagacacagctgaagacaaaattcactaactgaaagatgaatcttaggacagtatccagaatatagtacaaagagaccaaaaaagagaatatataaaaaagaaattaagagacaaggagaataaaatgaaagatgaaggtctaataagagttccaaaagaagaaaacagaaagaatgcagaagataaaatacttctcgagataacagagaatgttccagagctgttgacagatgccaatcctcagaatcagtaaattcaacaaagcccaatagggaaattaaaagaaattcacacctggctctgctcacaagggaggattaatcccaatttcattaaatcccaaaactccactaattgacagtaaagggatttttacatcaaataatataaaaccacaaaagcgggactaacagcagtgcacacaacacagatgtttggaagttggcaaaagaacagacgagaaataactgacctagtacatctgagacaaacctcaagccagaaggagtaaaactggataaacactccagttacagcacagaatcttcaaagtttcaggaactgacaacaccatgtacctctggaaaggggaataaaatgtagggactgaaaataaggcagactgagtgaacaatatttaagaggcagttaaatccctatctactccccaactccatgctcctaggtgactgcctctatcctctcctggcataagtctaaaagtttttctctagacagttgaaatgttatctggcctaggagatgataggcacagttgagtcttgggcaccatatggaaaacggtgcctgggtgattacattagcaatgaatgcttctggaaataaacatcacatttatggtcaattgatctgacaaaggtgtcaggcaattcagtgggagagagaatagtcttttcaccaaatggtgctgggataactggatatttacatggaaaagaattaatttgaatcctttaactcacactatacacaaaaattaacttaaaattgatcatagaactacatgtaagagctaaaactataaagctcttagaagaaaacacaggagggtaggatcaattggtcttggcaacttactggatatcctagaataaagcaaaaactgactcagattttaaaactgcttggctgagaagacaggaaaaagttcttccaggacacctaagtcgaatgtgtctttcctctttgctgatctggctctgaatcctttcactgtagcaactcaagagaactctatgcttagtcctgagtggtcctagcaaaccacggaacctggggacatcttggaagcttcaacacaggcatatataatgagaacaaatcaatttgcctttatagcataatgacaaaccagcacagtagtattaacctgacttgctggcctacaattttcagagagcagaacttccccggcttcttagttcagcagctgctgatggacatcaatcacaccaactcagcatcctgcccttctcttccaacccacactcccccctttcttcacagctctccttaatctatccttagatgtctcagcccagaagttagaaggcttattagcatgtcattattctataaccaaggtatacacagaaacattttgggggaagatgtttttcatatcttaaaatgcacgtaaaaccgctctgtagacaataaagtgttttagaaggtaacgtattattaagcttaaaaggtagatgtgtaagccataaaatacagtaacatctttgatgtgatgcttccaatcctaaattattcctctagaggagctctcataccttcctctaattacaagccacataaaggataaaaacacatttttcactttggtttcaggtttcaattttgttgatcttgaaatatacacattatctccttattaacaagaaaaaacttcatcaaggaaaaggtctcatcacatcaaaactggtctacccaatttatcatacatttggaatgctttccttttgagtctcttccatatattatatcatatacaacacacctcacttcttcaacacacggcctactcaatgtatctatttaatcttccctgaagttcaggtcatggtaattctttcttcctttctttctttcacttattattattattatttttttttttttggagacagagtctcgctctgtcacccaggctggagcgcagtggtgcaatctcagctcactgcaacctctgtctcctgggttcaggcgattctcctgcctcagcctccagaacagctgggattacaggcacctgccatcatgcccagctaatttttgtatctttagtagagagagggtttcaccatgttggccagattggtctagaactcctgacctcaggtgatccgcctaccttggcctcccaaagtgctgggattacaggagctagccaccgcgcccgtcccatggtaaatcttagaactcaaaaagatcttcaacattctgttggacaaacaagctataaatgcttgctaaagtgtaacctggatgttcccaagcttggcatggcaacatagtcacatggggagttttctaggccccactccagatttactgaatgaaaatttctaccagtggtgtgtgtgcgtctatttcttaagacgtcctgaagcagatccgcctggaagaactctgtagaggctcttgatttgcagtggacaaatctctactccaatgacagaaggcaggaatgtgaagagggagaatctataatcttaacaacaggaatatttctccctgagtggcagaaggattatgatattgaaaccaaagagaagaaaatataatctagtataccacatggctctgcagtggataatacctgcaaaatctaaaataatgaaactgctaaatggttttcaactttataaccaatctacagacaaagcaaaaaaggtttatagttagataacaatatacaaatattgtcaacctttacaacatgaaagtctggtacagctgcaagagctggaaggaaggaaggaagggaggaagggaaggagggagggagggagggaggaaggaaggaaggaaggaaggaaggaaggaaggaaggaaggaaggaaggaaagatggcaggggcctaatattatcattttacaaagagcaaggtccagagatactgtttaaagttgatagtacaaataaacagagatttaagtatatgaggtagggtcacaaatatagccaataaaagaactagcaattcaataataagttgggaagtagagaggtgaaataacttgctcaaattcagctcattagaaagctccgaggccagtgggctaaacatgggccagtcacactctagattccatgcactttaccagtatctcaccatgcccagccctgtgtgaggaaggaacttgcctaagcttagatgcctagttagtgttacagccagaaaaagaaactcaatcaggctgggcgcgatggctcacgcctgtaatcccagaactttgggaggccaaggtgggcggatcacaaggtcaggagattgagaccatcttggctaacacggtgaaaccccatctctattaaaaatacaaaaaattagccgggcgtggcggtgtgcgcctgtagtcccagctgctggggaggctgaggcaggagaatggcttgaatccgggaggcggagcttgcagtgagcccagatcaggccactgcactccagcctgggcgacagagtgagactctgcctcaaaaaaaaaaaaaagaaactcaatctctagtcttaaaattacttgttacagttatcttcaaattttcagaaaagaccacattaaaaatgtccctatttggttcattctttcaacatacaccaacatttcggctttttttgagatggagtctcactctcttgcccaggctggagtgcagtggcacgatctcggctcattgcaacctctgcctcctgggttcatgtgattctcctgtctcagcctcctgagtagctgggactacaggcgcatgccaccacgaccagctaatttttgtatttttagtagagatagggtttcaccatattggtcagactggtctcgaactcctgacctcaggtgatccaccgaccttggcctcccaaagtgccaggattacaggtgtgagccaccacgcccagccaacaccaacatttcttacaaagagctcctccacagctcccctcacctatgataagcattccatctattctccaagtctataccacaatgatggaggaagacactgcagcccaccatccattgtgtctgtcaaaacctgacagaggatccagaaccaacactgaagatgcaaagcaagtcagcctactcaactcttagtctacaagctaagcccatagcccatctgccgccacagagatgctgtgtttacgtgcacagaggcacccactgcctgctccaggagaggacatggcagcagcatgtgaagggcaggtggagggctgctccaaaggagacatgatctgattcatggaccattatgtgaataggtaacaccactcagtgactgctgctttataatttcatataatattttgaaatattcaatagaaatgacaatatctacccccaaaataattatttaaaaataagttatcacccaaactcattactaccggtaaaaagcaattaaaaaaaaaaaaaaaacagggtcttactctgttgacaaggctgaagtgcagtggtataatcatgactcatggcagcctcaaactcctgggctcaagtcatcatcccgcctcagcctcctgagtagctgggactacaggcagatgctaccacatctgacttttttttttttgagatggaatttcgctcgttgcccaggctggagtgcaatggtgcgatcttggctcactccaacctctgcctcctgggttcaagcgattctcctgcctcagcctcctgagtagctgggattacaggcgcccaccaccacgcccagctaatttttttgtatttttagtagaaacagggtttcaccatattggccagcctggtcttgaactcctgacctcaggggatctgcccgcctcggcctcccaaaatgctgggatttacaggcatgagccaccacgcctggccacatctgacttttttttttttttttttttgacacggagtctctattgcccaagctggagtacagtggtgcgatcttggctcactgcaacctctgcctcccgggttccagcaattctcctgcctcagcctcccgagtagctgggactacaggcgcatgccaccatgcctggctaatttttgtatttttttgtagagacggggtttcaccagattggccaagctggtctcaactcctgacctcgtgatctgtgcgcctcagtctcccaaagtgctaggattacatgtgtgagccacacacctggcctcatctgattaattttttaaaaccttttatagacagagggtctcaccatcttgctccagctgatctcaaactcctgccctcatgtgatcctcccaccttggcctcccaaagtgctgagattacaggtgtaacccactgcacctagccatcaatttttaaaattcaatttaattcactgtcacttaccccattttcagtacgtttttctccaggtacatttattacatttctctgagttcgttgctcttgggtctgacggccacctaaagaaataaaagaaccaaactcaccaaaaggcgtattagaaaaaagtaatattctcccatttcttcatgtattcaaatatttattgaacacaagtgtaaaataccaggctgagaaattcaagactttagtacagttgaaaaaatggtcttacaattaatcttttatatataaagttgttcaggctgcgctcagtggctcacacctataatcccagcactttgggaggccaaagcaggaagatagcttgagcccatgagttctagaccagcctcagcaacatggggagactttgtttccacaataaatattttaaaattagccgggtatggtggtgcaccctgtagtctcagctacttggggggctgaggcgggagaatgacttgagtgagaggggtcgaggctgcagtaagtcaggattgggctactgcacaatcttgctctgttgcactccagcctgggcaacagagcaagaccctgtttaaaaaaaataaattaaaaataaatgaaataaagtgtgtaaatgaaatcttttctttttacattctatctcagaatcttgaaattgacttgttatcaaaaggcttttaacacttaaaaatggagaagatggtaaattttatgtgtattttatctcaattaaaaataaaaatttggggctgggcgaggtggctcatgtctgtattcccagcactttgggaggtgctgggattctcccaaggtgggaggatcacttgagctcaggaattcaagaccagcctgggcaacgtggcgaaaatctgtctctacaaaaaaaaaaaaatacagaaagtagcgaggcatggtgacatgtgcctcatgtgcctgtagtcccagccactcacgaggctgaggagaatagcttgagcctaggaggtagagactgcagtgaaccatgatcgcaccattgcgctccagcccaggtgacagtgagaccctgtctcaaaaataacataaagataaaaatttggcattcatattaccaagagaggaaaaaaaagaaaaaaattttcaaaaaggcatttgcggccaggcatggtggctcacgcctgtaatcccagcactttggaaggctgaggcggacaggctgcttgaagccaggagtttgagaccagcctgcccgaatggcaaaaccctgtctctagtaaaattacaaaaattacccaggcgtggtggtgcacacctgtaatcccagctaactaggaggctgaggcaggagaattgcttgaacccgggaggcggaggttgcagtgagctgagatagcaccactgcacaccagcctgggcgacagagtgagactctgtctcaaaaaaaaccaaaactaaaagcaaaaaaaaaatccaaaaggcatttgcattttagggccaggcatggtggctcatgcctgcaatccctgcagtttcagaggccaaggcaggaggatcacttgagaccaggagttcacgaccagcctgggcaacagcgtgaaaccctatctttaccaaaaatacaaaaaattagctgggcgtggtggcacacgcctgcggtcccagctacttggaaggctgaagtgggaggatcacttgagcccaggaggcagaggttgcagtgagccaagatcatgccactgcactccagcctgggtaacaagtgaaaccctgtctcaaaaaaaaaaaaaaaaaaaaaaaaaaaaagacattcactgagatgggggctggacgtggtggctcatgcctgtaatcccagcactttgggaggccaaggcgggcagatcatgaggtcaggagattgagaccatcctggccaacatggtgaaaccccatctctactaaaaatacaaaaaattagcccggcatggtggtgcacacctgtagtcccagctacttgggaggctgagacaggggaattgcttgaacccgggaggcgaaggttgcagccaagattgcgccactgcactacagcctggcaacagagtgagactctgtctctaaaaaaaaaaaaaagaaaggaaaagaaaaaaagaatattagtaagttgaagggagaagtttagtgagcaaaagcaaaacaaaacatgagacagcacccaataagctactctctatgccacccttttaggcaaaggtaaaggggcagagggtagagtgttacaggtggggaagatggaattctgagtcggggcatgaaagagagagtgaatgtacagctcctgggctcatgcaatcctctcacctcagcctcccaaagtgctgggattacaggcatgagccaccatactcagcccgtttccaaactttataaagtgagaaaaaaataaccactctcctcaggacattaaggattatgtacatattaataagtaaaaggcaagactttttatttaagtatagataagtgagggagggtataggtgtctgaagaactcaggtagagagttaaaataaatccttagcactaaagcagcacttcaactgtcagccagtctaatcctcctcttcaggtggatgttcccagagaggacggaccctggtctaaggtaaaagtagatgaagagttgagcccggagccttggtgtcctggctccagatgtaatggtgtattctaaaagacagccttatgctacggaaagatgattttaaagtagatagtagctcattcaagggcaaattttcctttactataaaatacagataaaggggataacttgcaataaagaagtattatttttacaaaggattgtccttttatttgcttgagttcatttttttaaatattagaagtaatccataatcactgttaattaacaagttaaaggtttttttgttttgttttgtttttgttgttgtttttgaaacacagtctcgctctgtcgcccaggctggagtgtagtggcgcgatctcagctcgctgcaagctctgcctcccgggttcacaccattctcctgcctcagcctcctgagtagctgggactacaggcgcctgccaccacactcggctaattttttggtatttttagtagagacgggatttcatcatgttagccaggatggtctcgatctcctgacctcgtgatccaacctccttggcctcccacagtgctgggattacaggcatgagccaccgcgcccggccaaaggtcttttaactgtacagtgtatacgtgttcaaaaaaatttccttattttctttaaattttaattcaaaaatatatagtatattcccatggttcaaaaatcaaaaagaacaaagaggtatacaatcaacaaccctccctcctctgttctacagccacttttccctttccccccaggccaacaacatccccagttgcgtagatatctttccaaaactgctttatacatatacacatacaaacagatagatatgcacattactctttgctcatctttccacaaaaaaagactaagtgtgcacattcttttgcaccatgcttaattcatgtaacatgtttaggagatggtctgggtcagggcacagaggttcttcattatttacggctgcagagcattctgctgtgtagatggaccctaatttatttagctcagctctcctggtgggcatttaggttgttcctaccagcaatgctcagtgaataaccctgtttatatatcattttgtatgtgccagggcacagctttaggataaattctcagaaatgaaactgctgggtaaaaggttttatgttttgtaagtttaacagccattgccaaatttccttctatagaaggtgccaaccgcctcccacagcaatgcagaagacggcctgtttctcagagtccttgtcaacactgtgctattaactgttttaatctttgccaatgtgacagttaaaatatagtatttcaagatagttttctctgcatgtcttttattaggaataaggtgaatatcttcatatatcctagggccatgtatattccttttctgtgaactgtgtgtgtatatattttttctattattctactaagctttttttttttgagatggagtttcactcttgttgcccaggctagagtgcaatggcgcgatctcgggctcactgtaacctctgcctcccaggttcaagcgattctcctgtctcggccccccgagtagctgggattacagatgcatgccaccaagcctggctaatttttgtatttttagtagagacgggggtttcaccatgttggccaggctggtctcgaactcttgacatcaggtaatccaccccactcggcctcccaaagtgctgggattataggtgggaaccagcacgcctagccaagtttttttcctatcaaattttaggaattctttacatgtaaagagaattagccctttgcaatatgagctacaaatgctacttcccagtttataatttatcttttgactttttttttagatattattgccatgcagttatttttggttttgttttatttatatgtatttcctgagacagagtctcgctctgtcgcccaggctggagtgcagtggcctgatcttggctcactacaacctctgcctcccaggttcaagcaatttttctgcctcagcctcctgagtagctgggattataggcgcacaccaccacatcgggctaatttttagcagagatggggttttaccacgttggccaggctggtcacaaactcctgacctcaagtgatctgcctgccttggcctcccaaagtgctgggattataggcgtgagccaccacacccagcctatttttattttttgagacagggtctctctctgttgccctggctggctggagtgcagtggcacaatcatggctcactgcagccttcacctcctgggctcaatcgatcctcccacctcagcctcccaagtagctgagactacagggcatccaccaacacaaccagctatttagtattttctgtagagatggggttttgccatgcttcccaggatggtctcgaactacttggctcaagtgatctgcctgcctcagcctttcaaagtgctgaaattactagcctgagccactgcacccaggctttgttttaaataattcatttatcagtcttgtcttttatgttttagtgttacacttacaaaggccttgttcacttcaaaaataaaagatcttccagaactttcttctagtattttcatggttttatatatttttaaaatctagatgtttgaccaatctgatatttaccaaaaacaatccctttagtgtggcggtgggtgcctgtaatcccaactactcgggaggctgaaacaggagaatcgcttgcacccaggaggcagaggttgcagtgagctgagattgtgccactgtactccagcctgggtgacagagtgagactccatctcaaaacaaaacaaaacaaaaatccctttaaacaccaagtccctttatatgtctgagtacgttgtttaattaacttagagtcctgagaaggaaagaagcgttggtgcctaaaaagtgtgatgtaattggctgggtacagtggctgacacctataatcccagaactctgggaggctgaggtgggcaaatcacttgaggtcaagagttcgagaccagcctggccaacatggtgaaaccccatctctattaaaaatacaaaaattagccaggtgtggtggtgcacacctgtagtcccagctacttgggaggctaaggcaggagaatcccttgaactccggaggtggaggttgcagtgagccaagattgcaccactgtactccagcctgggcgacagagtgagactctgtctccaaaaaaaaaaaaaaaaaaaaaaaaaaaaaaaagtgccgtaatggtaaacaacactaacagaagccaaagtaacatgggataccaactttccctctagccacttgtaagtgcagggccgggtgtgtgtgaataatttaatatttattcctatttttcttaaattaactttcctagcaaaaattaacaaatgaggaagaaagcagttatctaccttgttcactgttctcagttggggagtcctcgtgtcgaaggaaaaatttcacttcttccctccgtggaccccatttctgaagatgttcgtacatcatatgatcaaagggtatgggacgttctaggaaaaagaccacatcttttttactccagaattaaaatgactccaaccaaaagtaaattttgtaaaaaacttaaatgaatgtatatatgcacacatgtatgtctacatgttacaattcaaagatattacaagcactgaatttcaacattactgagtaaaagcaagaatatgaatgggaaataatttaggcaacagataaacacaaaaagtatccacgaaagcaattttgcaacattaaatagggaacactgaaacatgccttttacaaaacttatttatcacaaagcactgtgtctcccattcatttgtttgtttggttgagatggggttttgctcttgttgccaaggctggagtgcagtggcaccatcttggctcaccgcaacctccgcttctgggttcaagagatgctcctgcctcagcctcccaagtagctgaaatcacaggcatccaccaccgtgcccagctaattttttgtatttagtagagagagggtttcaccatgttagccaggctggtctcaaactcctgaccccaggtgatccacccgccttggcctcctaaagtgctgggattataggcgtgagccatcacactcagcctttttttttttttttttttgagacagagttttgctcttatcacttaggctggagtgccatctcggctcactacaacctctgcctccagggttcgagagattctcctgcctcggcctcctgagtagctgggattacaggtgcccaccaccatgaccagctaatttttgtgtttttaggagagacggggttttaccatgttggctaggctggtcttggcctcttggcctcctggcctcaggtgatccacccgccttggcctcccaaagtgctgggattacaggtgtgagccactatgctcagcctcccattcttgaaagaaacataaattgaccaggccatgttatttcttaaaatgtcaggcgtggcaatcagaggtacgaaggctggacagggcacttcctggcaactcaggcaacattattgtgaatgtttgtcagtaccaagttaataaaaattaaatcctatataactaaatgtatttcaaatatttttttaaaaatcaaagcttactcacaatctctcactcctttactttttttgagacaaggtctttgctctgccacccaggctggagtgcagtggtatgatctcagttcactgcaacctccacctcccgggctcaagcgatcctcccacctcagcctcccaagttagctgaaactataggcatatgccaccatgcctggataatttttgtaatttttgtagagatggggtttttgccatgttgcctgggctagtactgaactgctgggctcaagcaatctgcctgcctcagcctcccaaagtgctgggattacaggtgtaagccactgtacctggccagtatctaaccaattacttgagaagagcactaactcagttgttgaatttaaaggaacacttttatatgtataatgcattccattttccttctctgtgaactgtctcaggtattatgcctatttttcaaaaatctgggttgtggctgagtggggtgactcacgcctgtaattctagcactttgggaggccaaggtgggcagatcacccgaggtcaggagttccagaccagcctggccaacttggtgaaaccctgtctctactaaaaatacaaaaattagccgggcatggtggcaggcacctgtagtcccagctactcaggaggctgaggcagaagaatcacttgaacctaggaggcggaggttgcagtgagccaagatcgcaccattacactgcagcctgagcaataagagagaaaactctgtctcaaaaaaaaaaaaaaaaaaaaaaggctggtcatggtggtgcacgcctgtggtcccagctactcaggaggctgaggtgggaggatcgcttgagccaacacacctggctaatttttgtatttttagtagagatggggtttcaccatgttggtcaggttggtctcgaactcccgacctcaggtgatccacccacctcgacctcccaaagtgctgggattacgggcgtgagccaccatgcctggcctacacccagctaattttttgaattttttgtagagacagggttcaccatgttggccaggctggtcttgaattcctgaactcaagtgatccacctgcctcggctgcccaaagtgctgggattgcaaaactaatcttttacataatcaagatgtttatatcaggttgggcgtggtagttcacgcctgtaatcccaacactttgggaggctaaggcaggtggaccacctgaggttaggagttcaagaccagcctggacaacatggtgaaaccccatctctactaaaaatacaaaaattagccgggcatggtggcgcatgcctgtggttccagctactcaggaagctgaggcagagaactgcttgaacctgggaggtggaggttgtggacagctgagatcgtgctacttcactccatgcactccagcctgggtgacagagtgagactctgtctcaaaaaagaaagttcatatcagctcacgtgctctatcaagaagcactgaaaagctggcatataaaaaaaaaaaaccctagggactgggcgtggtggcttacacctgaatcccagcactttgggaggcaagagtatcatttgagcctaagagttcaagaccagtctggggaaacacagtgagacttaattgctacattttttttttttttttttttgagacagagtctcactgtgtcgcccaggctggagtgcagtggcgcaatctcggctcactgcaagctccacctcccgggttttacgccattctcctgcctcagcctcccgaatagctgggactacaggtgtgcaccacctacgcccggctaattttatttttagtagagatgggatttcactgtgttagccaggatggtctcgatttcctgaccttgtggtccgcccaccatggcctcccaaagtgctgggattacaggcgtgagccgccgcgcccagcctcctttttttttaattagccgggtgtggtggcacacatccatagtcccagcgactagagaggctgaggcaggaggattgcttgagcccaggaggttgaagctgcagtaagccatgactgcacaatgcactccagcctgggtgacagagcaagaccctgtctcaaaaagagaaaaatgaaaaaaaaaaagattaaaaatgctagaatgatctgggggatagattggttaacagatttcagccaattctgtttttagtctcaccattttcaaaagtattaacacctgcaatttcttaaacttccctagcttctttggcatgagtcagacttactgttaccttagattttagctttttgaggtctgctaagtcattaaccacccatccatctgtgttgaacattccaaaatattacaatgctatcacatcctgttcttcaaccttgtagctttaagctattttatcccttttcattgtaattttagtgtaatttcaggaaagaacaaagattgatacggatgcatgtatggtttattcatactacttaagcagaagtccatgatacttttagactataaaatagcatttctcattagccaggcatgacagtgcacatctgtaattgcagctactcaggaagctgagatggaaggatccctttagcccaggagtttgaggctacgactgccattgcgctcaagcctggatgacagagcgagaccctgtctcaaaacaatcaaagcaaaaaaaaaaaaaagtttctcctctgtgagtctacagaaacctagagttccgtaagatgtcactaagggcttcatgagatattgtaactgaaaaaaattagcatttttgaacttcatacagaacatgatattagcatttagagtgacagacaatggccaagcagccctgttagcaatgtcaacagtggtctctcagccctgaatggctgtgtgcaggaccacgttcctttgataaagttcattctcaatcaggagttggtagatggtgagagtattgcagggaggagaggatggtgggctgatggcattagcttctccctccagaaacatcttccccaacacctctttatatgctaatgactgatttatagcaacaaacaagctctagctctgaaataggaatcttggaatttttcattctactgagagaatatttatacctcatgagctgactccctggctctgctattgttaacacttaaaaatacacattgggtaggttaaaagtgaactgtactgtgtatttttgcaattttttttttgggggggatggagtctcactctgtcgcccaggctggagtgcactggcatgatctcggctcactgcaacctccgcctcccgggttcaagcgattctcctgcctcagcctcccgagtagctgggattacaggcatgcgccaccacacccagctatttttgtatttagtagagatggggtttcaccacgttgaccaggctggtctcaaactcctgacctcaagtgatctccccacctcagcctcccaaagtgctgaaattataggtgtgaaccaccgtgtccggccaattttttattttttgagatggagtcttactgtgtcgtgcccaggctagagtacagtggcgccatcttggcttatacaacctctgtctcccgggttcaagcgattctcctgcctcagcctcttgagtagctgggattacaggtgtgcactaccacgcccagctaacttttgtgtttttagtagagacagagtttcaccatgtcggccaggctggtctcaaaccactgacctcaaataatccacccacctcggcctcccaaagtgctgagattacaggtgtgggccactgtgcccagcctgcaattcttgcttagttattaattatgtcttcctgctttatattgtattagtgtttatgtcttaacaaacatgtctgacagtttttgaagatgaggtgtaagataaagaggagaactctagacttatacccacattcaaaagaaatgaaggccgggcccggtggctcacgtccataatcccagcactttgggaggccgaggcaggcatatcacttgaggtcaagagttccagaccagcctggccaacatggtaaaaccctgtctctactaaaaataaaaaaattagctgggcatggtggcgggcgcctataatcccagctacttgggaggctgaggcaggagaattgcttgaatcaggaaggcagaggttgcagtgagccaagatggcaccactacactccagcctgggatacagagtgagaccctgtctcaaaaaaaaaaaaaaagaaatgaaaacatgtccacacaaacttttgtccatgaatgttcacaggagatttattcataagaaccaaaaacgtaaacaatctgctatggtctgaatgtttgtgttcccctaaaattcatatgttgaaactgaatccccaatgtggtaatattaggaggtggggtctttgagaagcgattaggtcatgagagctctatcttcataaatgggtttagtgcccctacaaaagaggcccaagacatggtggcccacggctgtaatcccagcactttgggaggccaaggcaggtggatcgcttgagctcaggagtttgaggtcagcctgggcaacatggcaaaaccccatctttactaaaagtgcagaaaactagcctgggaggtggaggttgcagtgagccaagatggtaccactgcactccagcctgcgtgacagaatgagaccttgtctcaaaagtaaacaggctgagcgtgggtggctcacgcctgtgatcccagcactttgggaagccaaggcaagcggatcacttgaggtcaggagttggagaccagcctggtaaacatggcgaaacctcatctctacaagaaatacacaaaaattagccgggtgtgatggcgtgcctgtaatacagctataaacttgtgtttatacttaagatttataactctaaatcttcagtgcaaccaaagaatttgatgtcaagacaagagataaaactttgtgagctacacaatctaagcacagattcaaggtataagtgattgtaatttactgttccattcctaggtaagttctagatttgcataaagaaaatcctgccattcatagaaatataatgcacattatgctgctgacttttttcttctttttttttttttaagagatggggtctcactctgccacccaggctaaagtgcagtgatatgatcatagctcactgtagccttgaacttccgggctcaagggatcctcctgcctcagcctactgtagctgggactacaggcgcaaacaatcacgcctggctctagctttgtcttatttaacaaacatcaaaggcaaaaacagaaacggtctcatcttagttgaaaatgaaatctgtctgtgcttagctcaagttcatatcagaactaagtatctgtagagcaaaaaacaatgacaagttaaacattaaagaagtaaatttcagccgggagcagtggctcacgcctataatcccagcactttgggaggccaaggcgggcagatcatggggtcaggaattcgagaccagcctggccaacatggtgaaatcccgtctctactaaaaatacaaaacttagccaggcgtggtggcacacgcctataatcccagctactcgggaggctgaggtggagaatagcttgaacccacgaggtggaggttgtagtgagccgagatcctgccagggcactccagcctgggacagagcaagactccatctcaaaacaaacaaacaaacaaaatatatatatagaagtaaatttcattccatatttttagttttgaaagtagcatttttttatatacacatatgcctataaaaagatttttaaaagcaagtgtattggccttttctaactgcaaggcctatatttagctaaatcatgtttctcagttttgcataaaattgtgtcttaggccacatttttattcacattgcttaggcttatcatttagtagctttatttttagttgttttactaatcaacattgtcagtaaattttcatttttttacattaaaatcaacttttaaacttttacatttattaaaatcaatttacaacctatatttaaatataccaagtctgaacataacctaataaaaattaaaacccattttgtcttaagccagttatttaacagaaatttattgtttccctctattcatcgtgtgtgtgtgtgtgtgtgtgtgtgtgtgtgtatatttttttaaagacagggtcgcactctgtcctctgtcacccaggctggagcactgaagtgcagtggtgtgatcaagcgatcgtcccacctcaacctctctagtagctgggactacaggcatgtgccaccacgcccagctaatttttgtattttttgtagagatggggtttggccacattgccaaggttggtctcgaagttctgggctcaagcaatctgccagccttggcctcaagtgctgggattacaggtgtgagctactgcacctggcaaaattttgagaagattaatttcaagaaagcttcgctatatttttttaaggaagtttaactgaacataattttcgttttaaagtagaaaaaacacaacccgatcaacatgacaagaccctgtctctacaaaaaataaataaataaaaggattgtctgggcactgtgcagtttgcctgtgctcccagctacttgtgaggctgagatggaaggatcccttgagcccaggagtttaaggctgcagtgagctatgatcataccacttcactccaacctgggcaactgagcaagactctgtctcaaaaaaaagaaaaagaggctgggtgcagtggctcatgcctgtaatcccagcactttgggaggccgaggcaggtggatcacgaggtcaggagttcgagaccagcctggccaatatggtgaaacctcgtctctactaaaaaatgcaaaaaattagccgggcatggtggcgcatgcctgtagtcccagctactcagggaggctgaggcaggagaatcactggaacctgggaggcagaggttgcagtcaactgagaatgcgccactgcactccagcttgggcgacagggcgagactctgtcatagaaaaggggaagggaaggaaggggaggggagggaaggggagggaaggcaatgggaggggaggggaggggagggaaaggaggggaagggaagagaagggagagaagggaagaaaagggaagagaagtgaggaaaggaaagaaaaggaaagaaaaggaaaaaacactactgatctggttaggttttatgtccccacccaaatctcatcttgaattgtaatccccataatccccacatgtcaagggagagaccagatggaggtcactgaatcatggaggtggtttctcatgatagtgagtgagttctcatgaaaactgatggttttagaaggggctcttcccccttcacttgacatttctccttcctgccaccttgtggaggagctgccttgctttcccttcaccttctgtcatgattgtaagtttcctgaggcctccccagccttgcagaactgtgagtaaattaaacctttttcctttataaatcattccatctctggcagttctttatagcagtatgaaaatggactaactaccctatacatatcatgtaatataaaatatacctaattagcatcttgtataatggaaatctattataagacttttaggaactttaaataaggttaaaaaacctcaagtaggaaacttaacaaaagataaaaatggaaggttttatctaccttactgactgccattagaactgacacctgtgtggggaagggaaccacacagagtagctaatgacctggccaaattaacagactgttacaggctgaactgtgtccccgctaaattcatctgttgtagtcctgacctcaagtacctcgaaatttaactgtatttggagacaggacttttaaagaggcaagaagataaaatgaagagatcaaagtggcccctaatccaatatgactagtgtccttacaagagggggaggtttgtccacagacaggcatggagggaagaaaagaaaaccatctacaagtcaaagagagagagagtcttcagaataaaccaagcctgctgacaccttcatctcagacttctggcctccatcactgtgagaaaataaattactgttgtttaagccacccagtctgtggcactttgttacggcagcctcagcaaaataatgcacagatccacagtgaaacggctctactggaaagcactgataattactattgaaggattctatctacgacatactgatcatactaatgtcagcagttatgggggcagtaatttgttttttgtttttttttttttttgagatgaagtttcactcttgttgcccaggctggagtgcagtggcacaatctcggctcactgcaacctccgcctcccaggttcaagcgattctcctgcctcagcctcccgagtagcagggattacaggtgcccaccaccatgcccagctaattttttgtttttttagtagagacagggtttcaccatgttggccaggctggtctcaaactcctgacctcaggtgatccacccacctcggcctcccaaagtgttgagattacaagagtgagccacagtgcccggccaggtgcagtaagttttatgtgagggttctctgaaacctaaaaaaaaaaaaatctctgtaagggttcctctaggtaaaaggactgagaaaggctgttacagtgcttgccctctccctttgatggcatccactggaagttaccttctcttcttcctagatccagcttcgttggccattttacttactaatctgtgtttactaagtgccttctatgaacactaggctggacactggggatataatggtgaacaacagacaagttcccgccttcaggaattttagtccaacaagatagagataaaaactactactacattatgtttgtttgtttttttttgagacagtctcgctctgtcgcccaggctggagtgcagtggcacactcttggctcactgcaacctccgcctccgggtttcaagggattctcctgcctcccaagaagctgggactataggcgtgtgccaccatgcctggctaatttttgtatttttagtagagatggggttttgacgtgctggccaggctggtctccaactcctggcttcaagtgatccacccgccttggcctcctaaagggctgggattagaggcaagagccaccgtgcccgacctgtatcatgttttgataaatacaacgacagtattagagcacagggacactaacaccctttgagattcacggaagggatgagaggcaaagaataaatagatgttagccaagctcctagggattgttctagacaacgaaggagcatgtacaaaagccacggtaaatgtactgtgctgtgactctgtgctccagggtggtagtcctcatccttgaggaggtaaaactaagttatgatttgagatgggctgggagacaaggatggcaccaaccgagtgactcgtatgagagagacaagcattctcaagaggccatagaccatttagggctataatactcgtgtaaaaattttattcccttacaatgggaaggcagatgaggaattagaattgataacaagtaacagagaacaaaagtgctaagaggctagagaagaaaaaaaacaagggaatgaatgatcaggctctaacactgctccccttaaaaacgttaattacaattacttaactgcctgcttcctgtagctgtcattaggctaacaattgagggcctgtccttttacttctaatttagtaatagtccaatgtttatcaaagtcaagtttctctccatgtatccttaaaattctttactctgaattctaagtaaaaagcacaagaccttgcaaaaaaattgtaatttatatacccacaagggacttgtatctagaatacataaagaacttttacaattcagtaacaaaaagacaaataacccatttttaaaatgggcaatggggtggggtgcagtggttcacacctgtaatcccagcactttgggaggcccaggcaggtggatcacttgagcccaggagtttgagaccaccctgggcaacatggcaaaaccctgtttctacaaaaattagccgggcatggtggtgcatgcctgtagtcccagctacacgagaggctgaggtgggagcactgcttgagcccagaagatagaggttgcagtgagccaggattgtgccactgttctccagcctgggcaacagagaaagacactgtctcaaaaataaataaataaataaataggcaaaggaactgaatagacatttctccagagaagatataaaaatggccaatatacacatgaaaagattttcaccatcattagtcattagggaaatgcaaatcacaatcacaataagacatatcttcacaactactaggatggctaaactcaagcagacagtatcaagtgttgatgagaatgtgcagaaattctccacatcgtatacttcgtatactgctgcagggaatgtaaaatgaagcaattgcattagaaaacagtctggtggttcttgaaaaggttaaacacgaattaccatatgacccagagattcctaggtttatactactaagagatatgaaaatatatgtccacacaaaaacttgtacattgtcaggtgcggtggctcatgcctgtaatccaagcactttgggaggccatggtgggtggattgcctgagctcaggagttcaagaccagcctgggcaacatggtgaaaccccgattctactaaaaatacaaaaaattagccaggcgtggtggtgcgcgcctatagccccagctactgggaggcggaggcacaagaatcgtttgaacccaggaggcggaggttgcagtgaaccaagagcatgccactgcactccagcctgtgggagagaccaagactccatgtcagaaaacaaaaaacaaaaacaaaaacagtttgtacatgaaagttcataggagcattattcataatagccaaaaaaaaaaaaaagagagacagcccaaacatctatcactctggcctgggagacagagtgagatactgtctcaaaaaaaaaaaaaaaagtatacaaaaaagcattttgtaaaactcagtcctgtgcaatataattacatttattttaattactcagttctttattaccacagataactaagaactacaagcaatattttccatttgataaatactaaattatatgtacttagttactttttttccccatctttatcagaaaaaaagcaaatccagcacaagcttagctaaaagatggtgatttgattttatcaatgtaacaatctttacaggacctaatacataccatttcccctccacacttcagctaaatggcagctgccttctccaggttccttgcaaaattctacaacatctcgacaggttgtttccggtgttataggaacttctgttaaaatctgttcattgttgctcaagaaaacagttaatatcatctgtaagacaaaagagtaaagctgtaatttagattccttatcacaaacagattaatctgtaaatttaaagtgatccctctacccaccccccgcccccaaaatgcctacagaattattttctggaaataataatagataagctgattctaaagttcatgtagaaagatgaaaaagacaagtcaggaaaattccaaatgaggagagtaatagaaaagaaagagcactatcttataaagtgctcaaaacaacatgacagcagtagatatatatatagatcaatggggcaaagtcataccccagaaatagacccaattacctatgaaaaaaatggcaaatgatgagggaggtatctcaaaaatcaaggagggaaaacgactatacaatgagtgatgtttgagcaaaatatatccatgtggaaaaaatggtttcataccatatatcgtacactagcagaagttcctaatagatcaaatatttagatacaaaccctaaagccataaaaagtccagaataaaacctgggtatattcccttttatagctttggaataaaggtgctgtttcaaactatgactcaaaaatcagacactatttttaaaaagactgatattcaagtacattaaatataataatctctttttttttttttttttgagatggagtcttgctctgtcgcccaggctggagtgcagtggcgcgatctcggctcactgcaagctctgcctcccgggttcatgccattctcttgcctcagcctccagagtagctgggactacaggcgcccgccaccacgcccggctaattttttatattttttagtagatacggggtttcaccgtgttagccaggatggtctcgatctcccgacctcgtgatccacccgtctcggcctcccaaagtgctgggattacaggtgtgagccaccacacccggccaagaatctcttataatccagaaaaacaaggtaggggaaaacatttgcaactcatattacaaatacaaagctaatcccctcaatacataaagcgctcctaaaaaatgataacagaaagaccaaaaatccaattcctttaaagaaattagccaggaaagtgtattaatatatcacagtaaaagaaaaataaatgacccttaaacataaaaatacattatagtgtatttgaaaaaataaaaatcgtctagccttactttattttatttttttgagacagggtctcactccgtcacccaggctggagtgcagtggcgtgatctcagctcactgcaacttctgcctcctagactccagagatcctcccaagtagctgggactacaggcatgtgccaccacgtccagttaatttttgtattttctgtagagacagggtattgccatgctgcccaggctggtctcaaactcctgagttcaagcaatcctctcgccttggcctcccaaagtgctgggattacaaatgtgagccactacacctggtgtttttttgtttgtttgtttgtttttcttgagacagagtcccactctgtcgcccaggctggaatgcaatgtcgcgatcttggttcactgcaacctctgcctccccagttcaagcaattttcctgccttggccttctgagtagctgggattacaggcgcatatcaccacgcccagctaattttattttattttatttatttatttttttgagatggagtctcgctctgtcacgcaggctggagtgcagtggcgcaatctcggctctctgcaagctctgcctcttgggttcacgccattctcctgcctcagcctcccgagtagctgggactacaggcgcacgtcactacgcccggctaattttttgtattttcagtagagacggggtttcaccgtgttagccaggctggtcttgaactcctgacctcatgatccgcccgccttggcctcccaaaatgctgggattacaggcgtcagccattgcgcccagccttattttgtatttttagtagacacagggtttcgccacattgaccaggctgatctggaactcctgacctcaagtaatccgcctgccttggcctcccaaagtgctgggattataggcgtgagccactgtgccgggttttttgttttttttttttttaatttcaaaaaaatactaacactttgatctagcatcttaagacatcatattggaaggaaatttttttttccccttttcctcagtggaacaatgaaagagatactttaaaaacaatacacctaaagtaaaaattaggctaggcatggtggctcacatctataatcccagatttgggaggccaaggtgggtggatcacctgaggtcaggagttcaagaccagcctggccaacttggtgaaaccccaactctgatacaaaagaaatacaaaaattagccaggcgcggtggcacgcacctgcagtcccagctactcaggaggctgaggcaggaggatcacttgaacccgggaggcatgaggttgcagtgagccaagatcgcaccactgcactccagcctgggtgacagagcaagactctatctcaaaaataaataaataaataaataaaaataaaggaataaagtaaaatttaaaccaaagattttctttaatcagaaggtattataaaacatttatgtctaatctttgacaaaaggtcagaaacaggccagaaatggtggctcatgacagtggtctcagctggaggctgaggtgggaggatcacttgatcccaggaatttgaagctgcagtgcagcttacaatcacgccactgcactctagcctgggcaacagagccagaccttaaaatctctgcattcgagtaagcatatgattttagtttgttgttaagatttttttttcatccaggcacagtggcttacgcctgtaatcccagcactctgggaggccaaggtgggcggactacttgagatcaggagtttgagaccagcctggccaacatggcaaaacactgtctctactaaaaatacaaaaaattagccaggcgtggtggcccgcgcctctagtcccagctactcaggaggctgaggcatgagaatcacttgaaccccggggggcagaggttgcaatgagccaagattgcaccatttcactccagcctgggcaacacagcaagactgtctcaaaaaaacaaaaaaaacaaaaaacaaaaaaaaagatttttttttcttacaagtgccctaaattcctacattctgaaattaagcatctttacatctatggtcagattttatgtaaccaaaattgataacagctttgaactggtttccttgccactaatctcccccgactctaactcctcaccgttaccatttcattttttttcttcttctttttttgagacggagtttcgctcttgttgcccaggttggaatgcaatggcatgaactcggctcactgcaacctccgcctcctgggttcaagcgattctcctgcctcagcctcccgagtagctgggattacaagcatgcaccaacacacccagctaattctgtatttttagtagagatggtgtttctccacattgatcaggctgctctcaaactcccgacctcaggtgatctacccacctcggcctcccaaagtgctgggattacagatgtgagccaacacgtctggcctaccatttcattttctaaaagtcaaataaagttattcccttgcttaaaatatttaagagctccccactgcccaacaccagcccttcccaaaacaccttcgctggtatataagcaggagataggtttcttaactgagcactccttaagagtctaatgtaatgatcatatatatttcttttttccctccagggaatctcatgaggcttggatttctataaaatatactctgagaaaaccttccaggttctaagtctctccaagcactaaacctccctccatcagcatcaatggagttctctctggcagccgtccctctgcccaagtacccttcctgtttgcctgtaaattcctattcacaattcaaaactcagctcctaactaccatttttgcaaaaacatccctttaccgcctccgctcaccagggaggccacatgctccttcctttacgatccagtggctcttcacacagatctctattgcatcacctcaatgactccctccctttatagactctgcactcttccaagcacttcacttttgagtctttaatttcccattgctgagtcaggacctgacgcataggaggcacactaaaatctggtcaactccatgaatgacacacaaatatagaacccccaccatgccctaagttgagaaaaaatatatacacacacaattgaagtaagatatatccagtctgttcaataaacaagcatcatccctcttccctgagcacatttctattttacaataaattttttaaaaattaagtaacagttacctctgctcactaacctgtaagaagaatttataaaaactggggatttttgtatactgaaataagtagcctggaatctacagaatttggaataaaacaggtaatcactggatccagctcaaaccaaggccaagactaatactttaacagtttcatcagaaacaactggaatatagttttattcttacttatacacatttattctacagttgtaatggtaaatattttccaatgtgacttcacaatctatgctcttaaagatctagtaatatcgggaggctgaggcaggacaatggcgtgaacccgggaggcggagcttgcagtgagccaagatagcaccactgcagtcaggcctgggcaaaagagtgagactctgtctcaaaaacaacaacaacaacaaaaagatctaataataaattttcccaaatcatgctttataaattgaagtttcaaatgagtaaaaaaatttttttttactaccttcccttatatgctattcctacagttcactagcaacaagcagaatgccctgtttcactcagtacttcggaatcggtttttcttccttgttccttacccttctacccactaaggcatcccacggtttgctctcaacgctctgagctagcaaaacatttgcacaatcattgcctcatgaatatagcacgcgtaaagcagtacccttaggcactcacagaggcacagcttgtgcttacttgctctgaaacgcggaattctttatgaatgcattgtcagaatgaaggatggtatggcagcattttggggtaccttctgaattaccaagactcttcagctcatgagtaagttcaatatgatgagggagggggagaggcacgatgacaggttgtaaatctggatatttttaaaagcgaagaacacccaaataacttatccaaaagtcactaaacattatttcaatttcttgtgttccattttatcactcgcaataaccctgtctttcctaattttagcaaaattcattttccctaatctctattattcaagctaatttcattataatcatggcagactttaaagctttctagagaaattaagctggttttgacctggatgaccctaaagcatcaccgaaaactgaagctgaaaagccgtgtgactgctaatgttattctagtaagatttcttcagcttaaacatgactaaagaagctccaaaacaaatatagtgtattgattctagatgcacttgcttgtattttaataacatctttgaaatcatagtacacctcacgatggcatgacacaatttaatgggtagcatatttttttctttaatagtatgtacaaaacagatgaaattcagtaggattaaggaaactaaatgaaaaaagaaaacaagttaatacgtttatccttcctaaatgattaatatgttaaaaataaaagatttggggccgggtgcggtggctcacacctgtaatcccagcactttgggaggccaaggcaggcggatcactaggacaggagatcaagaccatcctggctaacacagtgaaaccccatctctattaaaaatacaaaaaattagccggacatggtggtgggcacctgtagtcccagctactcgggaggctgaggcaggagaatgctgtgaacccgggaggtggagcttgcagggagccgagatagcaccactgcactccagcctgggcaacagagcgagactccgtctcaaaaataaataaataaataaataattaattaataaacaaataaataaaagatttggttagctacagttaggaaaacaaaaatttctaattgtgtgctgtaacaaatatagcatgtaatgacaagatgccctacttatgcctttcctcaaactgcttctctgccctgatgaatcacacaacaaatcctgcccctttctgctcactgacagtactctctacccatcctgacctgacctgagaaagactggaaccaatgtctgcccatcttgacccaacctcagataaagcctcctcttctcccctgctgtaacagactgtggctatttatagtacaactttcttacattaaattatcaatagttttcttgactacatcctctactggaacagtatctgtgactcattacctggtcttgaaatcatctaagtgtgtcttaacttgctccattttttttttcattcaaaaaagttggaaaatatcatactagaccataaggacaatacttgtgttctccagctcagtgcctggacacacagtggtgctcaagaaatgcaggatgaggcaggcagaaaactgacaaccattattaagtagcttaagacgtcatcttacccttgctttcaggaacatctgaactaagaaaatcaactgaaatcaaataatcactaatttaagtaaaccacacagatattttaacatttttacaaacttggtatttaaactattttcttggcaatccaaggaaaccaaagcaaaacacaaattgaggatgtataagctattaaaaaacaggaattagctgggcatggtgactcaagcctgtaatctcaacactgagggaggcagaggcaggaggatcgcttaggcccaggaatttgagaccaacgtgggcaacatggtgagaccccatctctactaaaaactaaataaatgaataaacaactagctgggcatcatggtatgtgtctgtagtcccacctactcgggacactgaggtagaggatcacataagcccaggagttcagtgctgcagtgagctatgatcacaccactatactacagcctgggtgatagagtgagatcccatctctaaggaaaaaaaaaaatctaaacaggaattatcctataatcaaagagacagacaatcacaagcattgacaaggatgtggagaaactgaaaccttcatatattggtgatgaagatgtaaaatggtacagctattttgcataacagtccagctggagtgcagtggctcaatctcagctcactgcaacctccgcctcccaggttcaagtgattctcctgcttcagcctcccaagtagctgggattataggcgcacgctatcacgcctggctaatttttttattttcagtagagatggggtttcaccatattggccaggctggtctcgaactcctgagctcacgtgatctgcccacctcggcctctcaaagtgctgggattacaggcgtgagccactatgcccggcctaaaaaattttaaacacagatttgccatatggcccccagcaattccactcctaggtacctaccctggggaaataaaaatatatgtccacgcaaagtcttgtatgcaaatgttcatagctgcactgttcatagtagccaaaaagaagaaacaaggccaggaacggtggctcatgcctgtaatcctagaactttgggaggccaacggtggcagattacttgagctcaagagttcaagaccagcctgggaaacataacaaaaccccgcctctacaaaaaattcaaaaagtagctgggcatggtggcacacgtctatagtcccagctactcaggaagcctaggtgtgaggattgcttgagctcaggaggtcaaagctgcagtgaactgtgatcatgccactgcactccagcttgagtgacagagcgagatgctgtctcaaaaaaaaggaaggaaagaaggaaggaaggaaggaaggagagagaaaaggaaagacaagacaaaaccaaaatctccattaacagataattatggaatatcatacaatggaatattattcagcaataaaagtaacaaagtattgacacatgctacaacatggatgaactttgaaaatactaagctaagtgaaagaggccagacacaaaagaccacatgttatatgattccatttatatgaaatgcccaaaacagtcaaatccatagagaaagaaagatgtgtggttgcctaggactggggatgggaatgaggagtgatggcaaataggcacaaactttgttttggtatgacagtaatgttctaaaattagattgtggtgatggctgtacaactatgtaaatttactaaagatcactgaatgttcacttaaaataggtaaactttacggcacataaattataacacaatgaagctgtttttaaaaagtaggatatataaaacttctagaaaaggaattcagaaacttgacttacatggtacaaagaaccctggaataggaagcccaagttctatccttagctatggcattgactgctgcaactggctggggaagctgctccttagtctatctctgggtcttggtttcttggcaagaactcagcagataatatgaaacacatatttgcaggaaaatggctctcaggcttttctggcccaacccaatcaggtaaagtattagatcccccagctcacctataccatctactacttctttctggtggaaaaggagctcagggataacaaaaaataactgaagagaaataaggtgataaaagctatactaaattttagtaacttgcaataactcacttggtaggttatgagtaaatagctcataaaagccacagaaaggatcagttggggtgagggtgggtgaacaccaggaagacccctttagctttccagcaggccacgcaccccaaaatgagaattgatgctaaggtcccttctggccctgattgcaactcagttcaccaatttaaaatctcagaaacattagagctgtaaggaaaactaagtctaagccatcaccctaaatgcttcatctcactttcctcaattagcctctcaaagactgaaaaacacacctgggagttgctgtcatccacacagaaaaaggagaataaaataaaggattggctcaactcccttctctctcatactccacaaacaatccattagcaagactgtcaacctcgtacccagaaactgataactcgtctccctggctactacccaagcccgagccaccaccacctctcagaaaggatgtctgcaagagcaaactcattcatctgtttccactctcacccttcagatacatcacttcattcaaaaccttcccgtggtttcctctctgagaataaatttcaaagtcctaactattgtctaagaggccctgcaagacctgcaacacacacatgcatacctctctgatctcagtgcttaccacactcttcatcccttctgcctccctcaacagggcaagccaactcctgcctcaggggctttgcacttgctattctctgcatagaccgcttcactcagctactgacattgtattaccctcttctttcaggcctctgctggaatggtgtcttagcaaggaagctttccttaaccgagagtctacctaaaatagcactactccatccctctgtcctcctaccctggtttatgtatttctgcttagcactcaaccaccacctgatctatgtatatatttgtttatcctctgtctgttgtcactagaacacataagcttcttgagagcagagtttcagttaattacctgctgtgtcagtagtgcctgaagcagtgcctggcacgtaagaagcactcaataaactcccccaattatacgtaaaatgtcccttttttttgagacagagtatcacgctgttgcccaggctggactgcagtggcgcgatctcggctcactgcaagctctgccttccgggttcacgccattctcctgcctcagcctcccaagtagctaggacaaaaagtgcctgccaccacgcccggctaattttttgtatttttagaagagacggggtttcaccatgttagccaggatggtctcgatctcctgaccgtgtgatccatccaccttggcctcccaaagtgctgggattataggcgtgaggcaccacacctggccacgaaatgtctttttatagtaggtttcttgaatcatgacaggtaggtgtttgcctgttttctcatcttcaagttctctgtagaaaagacaatattttacccctctaatcactgaattagtccacatcaaagagaagaaaaatattcttaaaaaaagttagtgtaaggctgggcacagtggctcatgcctataatcccagcactttgggagaccaaggtagacagatcatttgaggtcaggagttcgagaccagcctggccaacatggcgaaaccccatctctactaaaaatacaaaaaaaaattagctgggcgtggtggcacctgcctataatcccagctactcagaggctgagacagtggaatcccttgaacccaggaggcagaggttgcagtgagccaagatcacgccactgcacgccagcccgggcgacagtgactctatctcaaaaaaaaaaaaaaaattagtgtgaaagtcaggagccttgaacataactatgtggtattcggcagatttcactcaaacctagagaaacaatggatgtcccttgctctaaagcaggggtgtcccaactttgggcttccctgggccacactggagaattgtcttgggctacacataaaatacactaacactaatgatagccaatgagttagaaaaaaagatcattaaaaaacatatatatatcatgatgttttaagaaagtttactaatttgtgttgggctgcattcaaagctgtcctgggcctcctgtggcccggtgccatgggttggacaagcttgagctaaagcttctttccacaaggtggcactgcagggtaacgggggtgagttcagcactacccccttcccctgacacaaattttagggatgaagaattaactccaaggaaaataaaggtacagtttagtaagatcatattaagttcaatttccataattagggcttgtattattttggaaaaggaataaaattaaccttagagcaatgaaaatttttttctaaataaataagactgtagaagtacatatttaaccctcttacgaaggcagagacagctatacacccattttttttaatgtttcttttttttagagacaggatcttgctctgctgcccaggctgagcgcagcagcaccaatcctagctcactgcaccctcgaactcctaggctcaagtgatcctccctcgcctcaactttcaagtagctgagactgtaaaagcgcaccacagctaattttttttattttttgtagagatggggtctatgcccaggctggtctctaactcctgggctcaattatcctcccgccttggcctcccaaagtgctgggattacaggcatgagccaccatgctcagcctagacatatttaaatatctgagtagcatctactcaaagttaaatagccactacaatagatctcaataaccttatcaattctgttgagttctaatcactgttttacttgcgttaataatttcacattttaaattacattatacagtattcctgggaatacaaaatagacaccttagcttctatttgcattatttacttagtatatagtcccttcagtatttaaaagcataacgcattttgagagaacctatcttaaaccttgtagaaatgtgaaattcatacagctttccataataccaagatgtgtcatgactacaggatatagaggtgatacagctgaccacatttattctatccactaaaacttaaagaatactctagaataggttgggtgtggcggctcacacctgtatgccagcactttgggaggttgaggtgggcaggctgctcgagctcaggagctcgagatcagcctgggcaacatggcgaaaccctatctctacaaaaagcacaaaaaattagccaggcatggtagtatatgccagtagtcccagacacgtggggggctgaggcagggaggatcacttgagcccaggaggtcaaggctgcagtgagctatgatcaaaccactgcactccagcctgggtgacaaagtgaaactcttgtctcaaaattattattattatttttgagacagagtctcgctctgtcgcccaggctggagtgcagtggcacgatctcggctcactgcaacctctgcctcccgggttcaagtgattctcctgcctcagcctccctagtagctgggactagaggcatgcgccaccatgcctggctaatttttgtatttttagtagagacggggtttcaccatgttggccagatggtcttgatctcttgaccttgtgatctgcccgccttggcctcccaaagtgctggaattacaagtgtgagccaccgcgcccagctgtctcaaaattttaaaaaggccaggcgtggaggctcatgcctttaatcccagcactttcggaggctgaggcaggtggatcatgaggtctgaagttcgaaaccagcctggccaacatggtgaaaccccatctctaccaaaaatacaaaaattagcccgacgtggtggcacatgcctataatcccggctactcaggaggctgagacaggagaatcgtttgaacccaggaggcagaggttgcagtgagccaagtgacagagtgagacttcctctcaaaaataataaaaaattaaaattagaaaataatactctagaataaagaacagtatcaattctgacaccactgttcatcaatattgaaaattactttggctgggcgtggtggctcatgcctgtaatcccagcactttgggaggccaaggcaggcggatcatgaggtcaggagattaagaccatcctggctaacacagtgaaactcgtctctactaaaaatacaaaacattagctgggcgtggtggtgggcgcctgtagtcccagctactcgggaggctgaggcaggagtatggcgtgacccgggaggtggcgcttgcagtgagccgagatcgcaccactgcactccagcctggatgacagagcgagactccatctcaaaaaagaaaaaaaaaaattgaaagtgactgcttgaggctaggtgtggtggctcgtgcttgtaatcccagcactttgggaagctgagcccggtggatcacttgaggtcaggagttcaagaccagcctgggcaacatggtgaagccccgtctctactaaaaaaaaaaaaaaaattagccgggcatggcagtgcgtgcctgtaattccacctaactcaggaggctgaagcaggagaattgcttaaacccgggaggcagaggttgcagtaagctgagattatgccacactgcactccagcctagaggacagcgtgagactcctcctcaaaaaaaaaaaaaaaaaaaaaaaaagacaaagaaaattactgcttgaaataatggttgctttactaatgttgatcacgtgaatattatggaagcagaacaaacactgaattttaaaccacagactatgacctcttagtgggctctaaaatcaattagtgcctcaggaccagttttgttttttaatgaactagaacagaacaatatataacagttattaagagaatgaaaagacaagccacagactgggagaaaatatctgcaaagtacatatttgataaaggacttggccaggtgtggtggttcacacctataatcccagcacttcgggatgtctgtaatcccagcattttgggaggctaagatgggtggatcacttgagcccaagagttcgagaacagtctgaacaacatagggagaccccatctctacaaaaaacacaaaaagtagccaggtgtagtagtgcaggcctgtagtcccagcttcttgggaggctgaggtaggaggattgcttgagcccagaaggtcgaggctgcagtgagctatgactgtgccactgcactccagcctgggcacaagagtgagaccgtcactaaataaataaatacataaaggacttgtatcctaaatacacaaataactcttttttcttttttgagatggagtctcgctctgtcacccaggccgggcgcagtggctcacacctgtaatcccagcactttgggaggccaaggctggcagatcatgaggtcaggagatcaagatcatcctggctaacatggtgaaaccccgtctctactaaaaatacaaaaacagcattagccgggtgtggtggtgggcgcctatagtcccagctacttgggaggctgaggtgggagaatggcgtgaacctgggaggcggagcttgcggtgagctgagattgagccactacactccaccctgggcgacagagccagactccccctcaaaaaaaaaaaaaaaaaaaaaacctcaataatcataaaacaagctaatgtttttgtttctgtgtgtggtttttttttttttttttttctagacagtctctgtcacccaggctggaatgcagtggcgcaatctcagctcactgtgacctctgcctcctgggttcaagcgattctcccgcctcagcctcccgagtagctgggactacaggtgcctgcccccacactcagctaatttttgtatatttttagtagagatggggtttcaccatattggccaggctggtctcgaactccttacattgtgatccgcccacctcggcctcccaaagtgctgggattacaggcgtgagccaccgcgtgtggctgtttctgtgtttttgagacacagtttcactctgtcgcccagtctggagtgccgtggcacaagctcagctcactgcaacctctgcctcctgggttcgagcgattctcgtgactcagcttcctgagtagcggggattggggtgcctgccatcaggcccagccaatttttgtatcattagtagagatggtgtttcaccatgttggccaggctggtctcgaactcctgacctcaaatgatccccctgcctcagccaaggtgctaggattacacgcgtgagccaccgcacctggccaaaacaacctaatttttaatgggcaaatgatctgaacagatacttcaccaaagatgacatacaaatggaaaaataaacatatgaaaaacatgttccgtatcataggtcatttgggaattgcaaattattaataaaacaacagtgaaatactactacacacctactagaatggcccaaatccaaagcatcgacaacacctaacactggtgaggatgcggagcaaaaggaacttgcagttgggaatacaaaatggtacagccatgttggaagacagtttggtggcttcttaaaaaactaagcatacttttaccatgtgatccagcaatcccaccacttggtctttacccaaaggagttgaaaatgtgtccagacaaaaacctgcatgtgaatgtttatggcagctttgttcataattgccaaaacttggaagcaaccaagatgtccttcagtagatgaatggataaacaaactgtggtacataatactgctggaatattattcagttattcagcaatgttaaaaaaaaaaagcacaaatccagaagagagtccccactgtactttcacgtccccaccgtactttctgctccatctttctgtatatctaaaacttctataaaaaataagacagtacactgcccatggaaagggtaagatatggtttggctgtgccccacccaaaagctcatcttgaattgtaatacccatgtgtcaaggggagaaccaggtggacataattggatcatggggcggtttctcccattttgttctcgtgataatgcgtgagtctcacgagatctgatggttttataagcatctggaatttcccctgctggcattcgttctctctcctgtcagcctgtgaagaggtgccttccgccatgattgtaagttcctgaggtctcccaggcacgcagaactgtgagtacattaaatctctttcctttataaattacccagtctccggtagttctttatagcagggtaagagaagagtaacatagggtgttttctcctgacattttgacacgtatagatacgtgtctgagtatttaggtaagaactgagtcaccttgtaaaaggtatttcttagtgtgggttcatggtcagaaaagtttgaaagatactactctgagggcctcatgaaacctaccaggacttccataaaactaaatgaaaagtcactgcactagggaaaaaacatttccattatcatttattggtacttattattactcattatagtatggactttacacattctcaattgtcataccatctttgtgatataggtactactcttcactttacagattaggaaaaagagggtcagagaggttaaataatttgtcccagatgggcgtggtggctcacacctgtaatccagcactttgggaggccaaggcggatggatcacctgaggtctggagttcacgaccagcctggccaacatggtgaaaccccgtctctactaaaaatacaaatattagccgggcatggtggcacatgcctataatcccagctacttgggaggctgaggcaggagaatgccatgaacctgggaggccgagcttgcagtgagccgagattgccccactgcactccagcctgggcgacagagcaagactccgtctcaaaataaatgaataaataaataaataaaataataatttgtcccaagtctgctgaactaataaatactagagtcaggatttaaccctggcctgtgtgactccaaagcttaagctttaaaccactactctaaaatgcttcaaaataaaaaagataaggcagtaaaagtttcaatgggctgagccccgtggctcacacttataatcccaagactttaggaggctgaggcaaaaggatcacttgagggtaggagttaagagatgagcctaagcaacttgacgagaccacatcactatttaaaaaaaaacaaaaaccggcggcggggcgcggtggctcacgcctgtaatcccagcactttgggaagccaaggtgggcggatcacgaggtcaggagatcgagaccatcctggctaacacagtgaaaccctgtctctactaataatacaaaaaattagccgggcatggtggtgggcgcctgtagtcccagctactcaagaggctgaggcaggagacaggtgtgaacccgggaggtggagcttgcagtgagccaagatcacaccactgcactgcagcctgggcgacagagcaagactccgtctcacaaaaaaaaacaaaaggaaagaaaaaaaatagatgtttatgtaaaaacttggaaatatttatggtattattcataatagccaaaaagtggaaacaactcaaactgatgaatgcctaaacaaaatgtggtatacccatacactggaatattatttgaccataaaaaggattcaaatgaatgctaaacatggatgaagcttggaaacattaagccaagtgaaagaagccagatacaaaatgttcacatattatatgattctgtttttataaaatgtccaaaacaggcaaatccacggagagataaagtagattagtcgttggtaggagctgggaggaaggagagagcgggagtgactgaaaaatgggtacaagatttctttttgggatgaaaatataaaactagatagtagtgatggttgcacaatttgtgaatatactaagaaccaatgaattgtacattttgaaaaaatgaatgttattgtatgtgaattatgtaccaataaagctgttatttaaaaaacacaaacacaggctaggcatggtggctcacgcctgtaatcccagcaccttgggaagccaaggtgggtggatcatgaggtcaggagttccaagaccagcccagccaacatggtgaaacgctgtctctactaaaaatacaaaaattatcctgcacggtggcgggcgcctgtaatcccagctactcaggaggctgaggcaggagaatcgcttgaaactggaaggtggaggttgcactgagccaagatcgcaccactgcactccagcctgggcaacaagagtgaaactccatctcaaaataaaataaaataaaataattttaaaataataaaaaaaagtacggccaggtgtggtggctcatgcctgtaatcccagcactttgggaggccgaggcgggcagatcacaaggtcaggagatcgagaccatcctggctaacacggtaaaaccccgtctctattaaaaatacgaaaacattagccaggtgtggtgacgggcacctgcagtcccagctactcgggaggctgaggcaggagaatggtatgaacccaggagacagagcttgcagtgagctgagatcgcgccactgcactccagcctgggcagcagagcaagactccatctcaaaacaaacaaacaaaaaactagctatgccaagtattcaacctataccatcagtaaaatatttttctcaatgaaaacaactttttttttttttttgagacaagagtctcactctgttgcccaagctggagtgcagatgatcttggctcactgcaacttctgcctcccaggttcaagcgattctcctgcctcagcctctcaagtagctgggaatacaggtgcgtgccaccacccccggctaatttttgtatttttagtagagacggggtttcaccatgttgaccaggctggtcttgaactccagaactcaggccaggtttccggccaggcacagtggctcacgcctgtaatcccagcactttgggaggccaaggcgggcggatcagctgaggtcgggagttcgaaaccagcctggccaacacggtgaaaccccgtctctgctaaaaatataaaaattagccgggggtggtggcacatgcctgtaatcccagtacttggaggctgaggcaggagaatcgcttgtacccgggaggtggaggttgcaccactgcactctagcctgggcaacaagagcaaaactcagtctcaaaaaaaaaaaaaaaaaattatttcctttcatatatttttccttttctcagcccataaacatttatagctgtaccttaatgtctgcaaataccaaaaattcagtattaatccatttgccagtagcaactggggcttaaaacaacaaagataattagaaaaataatgttcctgaagaacacttttatataatgatgtatatcaatatagcttagtaaatactattcatctgatgaatacaatttacaaaggaaaagtaaatctaatagcaccccatctttttacaaatgactctatccatttcctctttcagatctgagccagctcttgaaaaccatgatgctgccttgaatttgcttataatgctcagagttactgttcttaaaatatttctcatcttcagaaaattaagcaaaagcgaagtgtggaaaacaaaattgcaagtgcctggagattatctatgtcatttacaaagggaaaatacttagatgtccctcaggccttgtggaatctaaattcgggcactaatgacatgagccatgataagatgtcctaatgaaacaagacagaccaccgttgttactgcacagtgacatggtggataaagtttcacctaattaggtgagctccagtgaagaaaaaattcactgatagcattgttcaataacaactgtaaccaagatctagaaatcactatcaaaatgaagactacacataaatttactaatctccatataaaacttgttatattaaaaaaaaaagacttgtctaagcttggttatcaactttaaaaagtgaaacctaaaggtttaaaaatatgttttcacaataaatgccttgttcatgttttatgcttctgaaaactatttgcttgttcaaagtagggtacatacagagctaaatttttttttaattttgttagtattgacattttagataaaatcagaatgaaatttataataagacacaacattaaaggacttttaccatttattaataataaaaatagctaattatttttgcttgctatgtttgaggataagcccctctccttttttttaactctcaacaggcctatgctaggtgctaggatgatgatcctgtcactgcagacagactggcgtgtccaaggccatgtgactgagatgcttcagacatgacaatctaacccaagtgtgtctgactccaaagcttaagtttctactcagatagttcaggaacaaaacagtgctaaagtttatgaacattaaaaaaaaaaacccaactattcaagttcttcatcttgatgaaactacaggaaataatctttacccaaaaattatcagatgggtaaatcaaactttttttttataatgaaagaactcacttcatacatgtaatatacacatacctttgaaaaacaaaacattgtaagtgtgacataaaaggatgaattagtagatattcatcgtaaaatccaaagattaatgtactcacaggctagcctgccaccatgcaaaacatttcctactacagaaaggaaattaaaaatgaaaactttaacgccttccttcccactctatgagttcccactcttttatgaatgtggtttgggtcctgagatttgggtctgctcagataccagaagagcccttataaaacccatctacaatttgtagaatttcaataccatcccttttgaagacactactgattaaaacattaggctgcatatgagttttcatatttctatgaccataatttctactcttgcaaacaacaacctatattatggagaatgactgaatttctcaatgttaatattgtcaggtacctgttttcacacagggagaagaacgaatattttcttggcagctactagacaaatcatacaccagttgatttcgtcctcatggcaacctcagagacatcaactgggatggccttcagatgacaattctttctcctcttctctgggcttcacatttgggcaagttcccaggggtcacgcttattttacatggcccatccctcttgccatgctgactcaactaagaaaaacacttgatgaaaaatgttcttcattatacaaatatttattgagcacctactacctgccaggcactggagatttggcactgacaaaatggacagggttctgcccttatggaattcttactatatagttgggaaaaagagactaaataaataggcaaaaaatatagtatactaggtggtactatatagtatggaaaaaaattaagcagacaaagaagactgggaatggggcaattttagttttcaataagtggttagaaaaagccttactgctgaaggataattctaagttggaaggggaacaaaagcctcactgaaggaggagaaaggatgagccataatgacagcttgaaggaagaccattcaggcgaagggaacaagtgcaaaggccctgaggcagaatgaatgcctgaagagactgagaatcaataaggagtccagcttgactgaagcagggaaatcaaagggagaggagtaggaaatgagagataagctactaattaggctttttctcagaaggatattagcagcccttggagggttttaagtaagaagtggcatattttgccataaaggtttacaggttcactgtggctgctttgttgagaacagactgaggcggggaacaagcacagaattaggaagacctagacatggtggtgcaggcctgtagtcccagctacttgggaggctgaggtggtaggatcccttgagcccaggagtctgaggctgcagtgaactatgatcctgctactgtactccagcctgggcaagagaatgagaaatctgtctattaaaaaaaacaaacaaacaaaaaaaaacaacaacaaaaagaaatgaaacaggaaggagtctcaggaggctaatataaaaatccaggagagaatgagaaccctagaggtaatgcaaaatagaacctgggtacactgtaaagttagctctgacaagatttgctgatggagtggatgtggactgtgagaaagaggtcatgccctagagagaaagcctaccacacctgctgccaaggtccccagagctcccctgtttctgccccatctgaagatctggttgttaggctatccctccagagtccttccaataaacccccttttgagaggttacaaaacaacagttggtttctgccacttgaaaccaaaaggaacttaaccgctacaattattatcattttacaaagagaaacctgagttgtaaaaaaggctcagtacttatcccagacccacagttacttgtagtagagttcagatatgaacaccagtctgactggctcctaagcctgcacttattccattaaagcacactgcttccaaggccttgagtagtcctctacctgccaacgggtacagagagcttaaaacaaaaacaagggggaggggcaggggaaaaaggccagcaacaatcaggcttcagtcccagcaacttccctagggagggacgcgtgagaagcaggaatcatcctattacggacaacgcccctcccttctcaccaccccaccaggtccagagcctcagctcctctgttcagcaaacacaggaaagccccagctccacgaagttgaaagctctggccacagaagaggagagaaaatggggccaaattcgcagatcacctttccttttgttttatcatctttctacactgctgcaaaatcattttctctctcttctcaaaaatagtgttgttattggcttagcactcaggatgttctcacaaggacccgtatttttgacacaaaaataaaacattcaataaacattcacattagtcctttttttttttttaatagacagggtctcactctgttacccaggctggagtgcagtggtgcaattatggttcactgcaccctcaacttcctaggctcaaactatcctcccacctcagcctcacaagtagctgggactggcacacataccaccatgcccaggatttttttttttttttttttttttgtagagacagggtggccgctctatgatgcccaggctggtctccaactcctagtcccaagtgatcctcccacctcagcttcccaaggtgctggtattacaagtgtgagccactgcacccagccctagtcctttcagaagaaaagcttacattagaagctgcaaacttaaaacaacactacataggtgcctcaatttttttctatagtcactaaagttgtttgcggggaaaaaagggataactttttgtttttcttgtaatttgagttagtaagcaagaaagtgattgctacttagtccttttgaaagcattcaattaaaagggttatgttgagatttcaagctatcaaaaagatcagtcataaaatcttagagccagattagaacctaatctatccaacactctttccccattttgtagatgaggaagtagaagcccagaaaaggaaataatttgtcaaggttaataaatcatcttggtaacaaaatgaagactaaaatccaggctgattctcatccctgcatgacacatccttgtcagtattcagttaccttgttcactgaatattaaaggaggtctgtaaaatgtctagcaacagcacgacataccatattctctcaaatctaatttcctcttcctctttttaatttcagtacctgataataatgggcactgaaaaagtcgggaagcctccccgcaacttttaaaatcatagaaatgaactgaaattaagtcacaaaagagacccaaaattgacacaggaacatatcaagtgtgaattataaatacagaggagcactgggcacagtggctcacgcctataatcccagcactttgggaggctgaggtgggcggatcacctgaggttgggagttcgagaccagcctaaccaacatggagtaaccccatctctactaaaaatacaaaattagccgggcgtggtgatgcctgcctgtaatcccagatactcgggaggctaaggcaggagaattgcttgaacccgggaggcagaggttgcggtaagctgagattgcgccattgcactccagcctgggcaacaagagcaaaattccacctcaaaaaaataaataaataaaataaataaataaataaagaggagctgaccacaaaatagatctataatatgatttgaaaacataagagggctccataaataccaacaagaccctggaaaatgtaagctaagtgacaatatttgttaaaaataaataagtccaaggcatttagttgagatataattgagctatcataaaattaagaactaaatatgctgcttttgagtgaaaaaaataagctaacaggacagagtgctaggacaacaggtaaaaccaagaccttcccatgcacatctggatatatggaaacccaatacaaatcatgcctatgaaaaactacattgtttcatccacaagacaatcccaagagatgaggatcaaaaagccacttttttttttttggagacggagttttgctcttgtcgcccaggctggggtgcagtggcacagtctcagctcactgcaacctccgcctcctggattcaagcaattctcctacctcagcctcccaagtagctgggactacaggcacccaccaccacgctaggctaatttttgtatttttagtagacacggggtttcgccgtgttgaccaggctggtgtccaactcctgaactcaggtgatctgcccttcttggcctcccaaagtgctgggattagaagaagcgtgagccactgcacccagccaaaaccacaaacttttataaaatcaagtctaaagagaaaacaccaaaaccccacagaatacatttctttgttcataaaaattcaccctaactacctatttcaccggtggctcacgcctgtaatcccagcactttgggagtccaaggcaggtggatcacaaggtcaggagttcaagaccagcctggccaacatggtgaaaccccatttctactaaaaatacaaaaaattaaccaggtgtggtggcgcacgcctgtaatcccagctactggggaggctgaggcaaaagaatcacttgaacctgggaggcagaggttgcagtgagctgagattgcaccattgcactccagtctgagagacagagcaagactccatctcgagaaaaaaaaaaagtatttcctaatccttcctgcattgaacaggaacaaggaaaagaaccatttatgacatgcaaatgaatgaggtaggtcatatcatccccacgttacagatggagaagcagactcaagagatgcttgacaccttgctggggatcagaatctaaacccagggatgaccccaaaagcctactatatcacattgcccataaggatccctaagtctcttagaacagggacaatttggccgggcacagtggctcacagctgtaatcccagcactttgggaggctgaggcaggcagatcatgaggtcaggagatcgagaccatcctgggtaacacggtgaaaccctgtctctactaaaaatacaaaaaattagctgggcgtggtggcgggtgcctgtaggtcccagctacttgggaggctgaggcaggagaatcgcttgaacccaggaggcggaggttgcagtgagctgagatcgcgccactgcacttcagcctgggtgacacagtgagactctgtctcaaaaaaaagaaaaaaaaaaaacaacagggacaatttggcaggccactgctctccctccatcaaggtgagctggacagtgttattctcaaaggagaaggggagggatggagaagggagaacagtgttcacatacgacttgcacactggacctagctttggtctacattttgcttccttcacacaaggccagccaaaactcatgggctctggaccctaccttgtcaccaagatcttatacctggggaatcaaatgaccttggaaattctaaaccccagaaccaaatttcaaccatcaaaattattcagtctagcagtcttcctcctccttgactgccacctccaacaataacagtaatagcacccacttattgacatttactatatgctggactttgtgctgatcactttccatgtataacaactttcaagcctgccagaaatcctgttttttaaagtatctttcttatttttacaaattaatatacatacactttaaaaaaaaaagtcaaccaatagaggaaataaaaaatagccccctaatgacccacactttaaacagcaggtacatacatatcctttcaaaccctttctacaccacaaaacactttccttcctttttcacaatgaggccacatgaagtagaatgttagttttccagctaacaatatgttttgtcagctgaaaaacattctacctcatcctttttttttttttttttttttttttgagatgcagtcttgctctgtcgccagactggagtgcagtggcgcgatctcggctcattgcgacctccacctcccaggttcaagcaattctcctgcctcagcctcccgagtagctgggactacaggtgcgtgcaaccacgcccagctaatttctgtatttttagtagagacgggatttcaccgtgttagccaggatggtctcaatctcctgaccttgtgatctgcccgcctcggcctcccaaagtgctgggattacaggtgtgagccacagcatccagccctcattctcttttttaaggctatttctctatatgatcacatcataatttatttagagacaggcattattaggcagggtgctgtggctcacacctgtaatcccagcactttgggaggctgaggtgggcggatcacgaggtcaggagttcgagactagcctggccaatatggtgaaatcccatctctactaaaaaagtacaaaaattagctggacgtggtggcgcacacctgtagtcccagctactctggaggctgaggcacgagaatcggttgaactgggaggtagaggttgcagtgagctgagatcacgccactgcactccagcatgggcgacagagcgagactccgcctcaaaaaaaaaaaaaaggagacagcaaatgagtgtctttaagtccacagtgcctatgatcatgtgggtatataataaaagggtaataaatatttgttgtatgtcactttctttgtactacatttatcttccctactgggccatcacatctttcacaatgccctggcatttagtcagagcacaaatatatttgttgaaagtacaggcatatcttgttttattgtgctttgctttattgagttctgcagatattgcattttttttaacaaattgacgggctgtggcaaccctgtgtcaagcacgtctactggtgccattttccaacagcatgtgctcacccatgtgtcacaattctctcaatatttcaaactttttcattattattatatttcctatggtgatctgtgatcagtggtctttaacgttactattgtaattgctttggggcaccacaaatagcacccacgtagaacagcaaacttaactggtaagtgttgtgtgtgttctgactgctccaccaactggccattcccccatttctctccctttctcgagcctccctattccctgagacacattattgaaatcaggccaattaataaccctacagtggcctctaagtgctcaagtgaaaggaaagtgaccatgtctgtcactttaaatcaaaagctagaaatgattaaccttaagaggaaggaatgtcaaaagctgagataggctgaaagctatgtctcttgccaagttgtgaatgcaaaggaaaacttcctaaaataaattaaaagtgctacccagtgaacacacaaatgataaaagcctgaaacagccttagtattgatatggagaaagttttagtagtctggatcaataaaatgagctataacattcccttatgccaaagcctaatccagagcaagggcctctcttcaattctatgaaggctgagaaaggtgaggaagctgcaaaagaaagttggaagctagcagaggttggttcatgagcttcaaggaaagaagtcatctctgtatcataaaagtgcaaggtgaaacaacaagtaatgacagaaaagctgcagcaagttatccagaagatccagctacaatcactgacgaaggtgactacactaaacaacactgtagacagtgattttttcttttcttttttttttttttttgagagagagtctcgctctatcgccaaggctggagtacagtggcgcaatcttggctcactacaacctccacctcccgggttcaagtgattctcatgcctcagcctccagagtagctgaaattacaggtgcccaccaccaggcctggttaatttttgtatttttatttttactattatttttaatttttgtatttttagtagagacaggtttcaccatgttggtcaggcttgtctcaaactcctgacctcaggtgatccacctgccttggcctcccaaagtgttgggattacagctgcgagccaccacactcggccaaacataacctatatgcactgagaaaccaaaaaatttgtgtgactcactttattgcgattatttgctttattaaagtagtctggaaccaaactcgcaatatcttcaaagtaagcctttatagatttaacacccaggatataactacttcccgctcagcccaggccacttgacctttctggatctcaggatgcatacacaattcaaacttgaaacccacctgcttcaccaggagcttccctaacagggctttcacataaagaggtctactcaggtattaccatgagaagtcagcattacaaaggatcttagcagttattagtctggatttctcctcgctttatagtaagagagttcataaattatggttttatgacaaactaataaagcttcaaatcacaagaaatacattgaaaatttcaaaacaaaagtacaaagcagttaagtttagattatggtaggtataggccatgcacagtggggaagacaggaggttgagaccagcctgggcaacacagctagaccctgtctctaccaaaaaaaaaaaaaaaaagccaggtgcagtggctcatgcctgtaatcccagcactttgggaggccaaggcgggcagatcacaaggtcaggagatagagaccatcctggctaacaaggtgaaaccctgtctctactaaaaatacaaaaaaaaaattagctgggcgtggtggcaggcgcctgtagtcccagctactggggaggctgaggcaagagaatggcatgaacccgggaggcagagcttgcagtgagcggagatcatgccactgcactccagcctgggtgacagagcgaaactccatctcaaaaaaaaaaaggcaaaaaaaagtagattaaggctgggcacggtggcacacgccagtaatcccagcactttgggaggccgaggcgggtggatcatgaggtcaggagatcgagaccatcctggttaacacggtgaaaccccatctctattaaaaatacaaaaaattagccaggtgtggtggcaggtgtggtggcacgcacctgtagtcccagctactcaggaggctgaggcaggagaatggtgtgaacccggcaggtggagcttgcagtgagcagagatcgcgccactgcactccaacccaagcgacagagcgagactccaaaaaaaagactgtactagatactttttggggtggagagtggaatgtgaaagcaatgagattttgcaaaaatctagatgtgtagtacagcctccaaaaacattgagaaacccatttcttatctcatggtagtgtaaaattttggtttcagtaattcctagcaccagacttctcctctgaatattagccaatacatcacaaactgctagaaagttatagtatgatatagtatatatcacactatagatctatagtgtgatatctggtgtatgatatatggtatatataatactatagatatatagtattataaagtatatataatactatagatatataaatatagatatgatatactatatcattaaccataaagcttcagcttaagagacttcgataacaattggttgtcacctaacaaaaaaagctaacaaaacactgaggttcatttttccattacatttaatcatggaacttagctactgtgactttattaccaaaagtataagcagctactattgctattataaaaacagcattttcctctcctagttatcccacagaagccttagtatctaactaccagcaactctcaaaaaggacaagaaaccaattggaccataaggtattctctattaagagtgatttttaagagtttgttcaattccagaggcaaataaccaaccacacaaagagactaaaattgggctctaatgtttttgttttatggcaagacatggcagtataaaaagcacggccgggtgcagtggttcatgcctgtaatcccagcactgtaggaggccgaggtgggtggatcacccaaggtcaggagttcgagaccagcctggccaaaatggtgaaaccccaactctactaaaaatacaaaaaaattagccagacatggtggcgggcacctgtaatccgagctacttgagaggcagaggcaggagaatcacttgaacctgggaggcagagactgcagtgagccgagatcacaccactgctctccagcctgggcaacaagagcgaaactctgtctccaaaaaaaaaaaaaaaaaagtgcaagaagccaaaacccatagtgtaaggcagtgttaccttttatgtaacataaattggttacatttacaggatcactcattcattcatttaggaaaattttactcagcccagcttggccctgggccaggctctgagctaacttctgccctcactaaacttggagcagacacagagaaaggacagcagaaaactatggtacagaactgcagaatgccacgagatcccacagaagggctgcctgctccaacaggaaagacttcccaaaggacgccacggaaggttaagacagaaaggagtaagccacagatggaatgagagggtgggcagattatgtcccaagaagacaggacagactggaaacagcagggccggactgctaatcaacggcagatgaaagcaggactgaagaatcccccattaggagctgctttcttctgtgccaaaaacttgacattcaaagaaccatacgaagatttggttgtttccagccatgcgtcttcattctataaggtgataaaggtcctcctcttacctgtcttccaagtactaaatagtaatctttttatatttttattttacttttgctactcttttctactctattaacaaagaagtggagactctcaaaataatccagtgtgttaaatatactgactgcaaaaaaagataaaaccatgaagtctccccagacatagtaggattctaaagtgtttcagagagaaagagtggcttaattgtaacagtattaattaaatgctgataaaaaccatcctctcaaaatttttctaattttaattataaatctaaatcctttatttaatcacactactgctgtgcttgttaatgttgcagcgaacaaggaaactagttacctaaagacatcaattagaaagcatcctcacaaaatgacacttcaacatttttttcttcacctgtgaaaacttgctaaatgcctatgtgaaattaagcaatctctaaagcaagaatgtctttgaactatagtgaatcaaaataatttaatgtttttaaaaaaaatttttttttaatacagacaaggtctttctatgttgttgcccaggctggtctcagactgctgctggcctcaagcaaccctcctgccttggcctcccaaaatgatgggattacaagagtgagccacccatatccagcctgacattttaaagataataaatattttgaggataaaaacacacatctatagtgtatagttactatacacaagggtctcactatgccacctaggctggagttcaatgataccatcacagctcaatgcagcctcaaactcctgggctcaggcatttctgccacctcagcctctaaagtagctggggactacaggtgagcaccaccacacctggctaaatattttactattttttttttaaacgcagtctccctctgtcaccaggctggagtgcagtggcacgatctcagctcactgcaacctccacctcccgggttcaagcgattctcccgagtcagcctcccaagtagctgggactacagatgcacgccaccatgcccagctaatttttgtatttttagtagagacagggtttcaccgtgttggccaggatggtctccatctcctgatgtcatgatccacccaccttggcctcccaaagtgctgggattacaggcatgagccaccacgcctggcctgtatttttatttttattttatttatttatttatttgaaatgaaatctcactcttgtcacccaggctggagcgctgtggtgcaatctcagctcactgcaacctctgcctcccgagttcaactgattctcttgccttagcctcccgagtagctgggattacaggcacacaccaccatgcccggctaatttttatatttttagtacagatgaggtttcaccaagttggccaggctggcctcaaactcctgacctcaggtgacctccccacctcagcctcccaaagtgctaggattacaggagtgagccaccttgcccagcctcttttaggttctttttatgtaacaactcatttaaaactcgtaaaacctaatgaggtaggtactactatgccctccattttatagatgaggaaactgagacgcagagaaattaagtaactcacccaagattacagggctaggaaaagacagtgttgagattcaaacccagatagtctgttccaaaatctgtactctttactgcctcccagtagttttccaaacatacaaaccaagtattcataactgaaaactactataataaaaccccagccatctataatccttaaggaattaattcttatgaatggcagcattctctgaatggctggggatttaacccttccatctcaggcaaaatctgaaattgtgttgtgcatatgatggccactggcacacatggctattgagaacctagggtatggttaagccaaatgagttgtgtcatatacgtaaaatatgttctaaaatttgagagacttagtattaaaaaaaagaatgtaaactaccccactaatgatgttttaatattaactacatactcaagtaattttttttttttttttttgagacgaagtctcactctgtcgcccaggctggagtgcaacggcacgatcttggctcactgcaacctccgcctcccgagttcaagtgattcttctgcctcggcctgccaagtagctgggactacaggcgtgtgccaccacgcccagctgatgttttgtatttttggtagagatggggtttcaccacattagtcaggatggtctcgatcccctgacctcatgatctgcccacctcgacctcccaaaatgctgggattacaggcatgagccactacgcccggcctcaagtaatattttttatataatgagttaaataaaatatattaaaattaatttcaacttcattcttttacttttttttttttttttaggcagagtctcactctgtcacccaggctggagtgcagtggtgcgatctcagctcactgcaatctctgcctcccaggttcaagtgattctcgtatctcagcctccccagtagctggcattacagggcgcctgtcaccacacccggctaatttttgtatttttagtaccgagagggtttccccatgttggccaggctagtctctaactcctgacctcaagtgatccacccgcctcagcctcccaaagtgctgggattataggcgtgagccaccatgctcggcctcttttgcctttttaaagaggctcctagaaaatattaaattgtggccgggcgcagtggctcacgcctataatcccagcactttgggaggccaaggtgggtggatcacttgaggacaggagttcaagaccaacctggccaacatggtgaaaccccgtctctactaaaagtacaaaaattagccaggcatggtgacacatggctgtagtcccagctatttgggaggctgaggcaggagaatcacttgaacctgggaggcggaggttgcagtgagccgagaccatgccactgtactccagcctgggtgacagagcaagaatccatcacaaaaaaaaacaacaccaaaaattagccagggatggtggtgtgcacctgtagtcccagctactcaggaggctgaggcaggaggattgtttgagtccaggagtttaagtccaggactttacagtaagtctgtcactgcattccagcctgggcagcaaagcaagaccctatctcttaaaaaaaaaaaaaaagttatgtttctattgcacacagctcatctaaaatgtatccagttgctgtctacatcattgatattatttactgttttcttgatgactcagtcatcatgaggaactttaactactaccctatgtgtaatctgtcatctgtaattgtgacaattgttgggatgactaaggtcaggctgcccaccttcagacctcaacctcaggttgtgcttgaagctatacctctgtatgatttccagtctgagaccacactctccagccagtctgtctgccaacgactacccctctagtaatctcagatgcagcttctaatgacttagaagcctggtaaattagaactgtgtaacatgtaagaataaaggttatgtgaaggattgaagaagtctacaaactgaattcagtttcaacgccaagttccttgacaactattttgatcactcagagacccttctctgccttgactattgtaagggactactctcttcaactccagacacttaaaggtatcaattttaacttaaattgcagcactttacatctcagcttaagatccatcagctgggcatggtggcccatgcctataatcccagcatcccagcactttgggaggccaagggggggcggggtgcagggggaagaatcaccagaggtcagagttcgagaccagcctggccaacatggcgaaacttcgtctctactaaaaatacaaaaattagctgggtgtggtgatgggcgcctgtaatcccagctacttgggaggatggggcacgagaatcacttgaacctgggaggcagcggctgcagtgagccgagatcgtgccactgcactccagcctaggtgacagagcgagattatgtctccaaaaagaaaaaaaaaaaagatccatcaatagtagtttcagtttgagaagatgcagataaaaacgttctggaggtagatggtgataatggttgctaaacaatgtgaatgtacttaatgccacagaactgtacacttaaaaatggctaaaatggtaactcatattttaacattaaaataatccttcaatattttcatatctttctcaggaacaggttcaaattcttatgtaggtaatacacttccctcacatctggcttctaccacttttccagcctcatccccttcctcttacctcctttggcctcatatcctaggcaacttccctcaacataccatgctgattcagacctcaacattctgcatgtcaatctttctacctggccaggcgtggtggctcatgcctgtaatcctagcactttgggaggccgaggcgagtggatcacctgaggtcaggagtttaagaccagcctggccaacatggtgaaacgctgtttctactaaaatacaaaaattagctgggtgttgttgtgcacacctgtaatgccagctcctggggaagctgaggcatgagaatcacttgaacctgggaggcggaggttacagtgagacaagatcgcactactgcactccagcctgggtgacagagcgagactccatctcaaaaaaataaaaaataaaataaaatccttctacctaaaagtccttccctatcaccttcactccctcttcctcaatcttccaaaccccactcaaatgttgcctcctctgtgaaacttcccaacatcctgaggttgagaagacctctctgccaccgtactctgctgcaccttgtatcctgacttttatcttttggaatggcatgttttagttacatgattgttctcgacaatgtgagctcaccgaaagcaatggctgacccagcatgtaaatgatgaatcctaaaggcatgctgagttccttcagtaagcaagtacatgttaaatgcctaccagagaccaacaatgtcctaagtgccaaggatactgcagtgggaaaagaaaacaaaactctgctttcatggtgcttccacaaataaacaccaggctgatataagtactacaaagaggaactggctgggcgtggtggctcacacctgtaatcccagcactttgggaggccaaggcgtgtggatcacttgaggccagacgttcaagaccagcctgaccaacatggcgaaaccccgtctttactaaaaatacaaaaaactagctgggcatggtggcacacgcctgtggtcccagctgcttgggaggctgaggcacgagaatcacttgaaaccaggaggcagaggttgcagtgagccaagatcatgccagtgcactctagcctcggtgacagagtgagactctgtctcaaaaactagtaagtactacaaagaggaataaagcacaagaaggggagaggcatttcatacaagatggaagatgccatcgaggtagagaccccaagaagggcttttcagctgactgacaggacactgcatgaagtgaaccttattctggttctgagtcaggtctggaaaacagaaagcactgcacagggaaggtaaattttaatgtcttttttttttttttttttttttttttgagaccgagtttcgctcttgttgcccaggctggagggcaatggagcaatctcgactcaccacaacctccgccctccgggtgcaagtgattctcctccctcagcctcctgagtaactgggattacaggtacccaccaccatgcctggctattttttttgtattcttagtggagatgaggtttcaccatgttggtcaggctgatcttgaactcctgacctcaggtaagccacccacctcggactcccaaaatgctgggattacaggcgtgagccaccgcactggctaaactttgatttctaagaaaagcaaactattctctctctgtccatattaacttaatagattttgcaattaaccacctagctactctcagcatgaagggcacaagcattctgcttcagagtaatagggtaattgtgatccttttctgactgaatcttgtttgctaagaagaagcctcatggttgctggagaaaacttaaagtactcagtaaacatttgctcttttttttcttttagacaggatctgtctgtactctgtacagcctgtactctgccaggctggagtacaatggcatgaagacggctcactgcaacctccacctcccaggctcaagcgatcctcctaccttggcctcctgagtagctgggaccactggtgtcagccaccatgtccagctaatttttgtattattttggtagagatggagttttgccatgatggccaagctggtgttaaactcctgggctcaagcaatcctcccacctctgcctcccaaagtgctgggattacaggcatgagccactgcgcccagcacttttttttttttttttttttaaagagaccaggtcttgctctgttgcccagactgaagtacagtggtgtgatcatacctcactgcagcctcaacttctgggttcaagcgatcctagtgccttagcctcctgagttgctgggtctacaaaggcatgccactatgtcctgctaatttttatttttatttatttattttttttttgagacggagtctcgctttgccgcccaggctggagtgcagtggcacgatctcggctcactgcaagctccgcctcctgggttcatgccattctcctgcctcagcctcccaagtagctgggattacaggcgcccgccaccatgcccagctaattttttgtattttttagtagagacggggtttcactgtgttagccaggatggtctcgatctcatgacctcgtgatccgcctgcctcggcctcccaaagtgcgggattacaggcgtgagccactgtgcctggcctttaattttttttaatatagacagggtctcactatgttgccctgtctagtctcaaactcctagcctcaagcaatccttcccccttggcctcctgaagtgctgggattgcagatgtaagccatggcgcctggcctactgacttttttttttttttttaagacacagtctcactttgttgcccaggctggagtgcagaggcacgatcttagctcactgcaatttccgcctcccaggctcaagcaattctcctgcctcaccctcccaaatagctgagattacaggcgcccgccaccacacctggctgatttttatatttttagtagagatggggtttcactatgttggcgaggctggtctcgaattcctgacctcaggtgatccgcctgccttggcctcccaaagtgctgagattacaggcgtgaaccaccatgcccagcccctaactacttattacatatagtaacagacaatgctctaagcacctgacaatcctaacagtatcatgaaatatagtgttattaaacccatttttacaaataggaaaataaggcacaaaggggttaaacaatttgtccaaagttggctggacgctgtggctcatgcctgtaatcccagcactttgggagggagaggcaggcggatcatgaggtcaggagtttgagaccagcctagccaacatggcgaaaccccatctctactaaagataaaaaaaattagctgggcgtggtggcacgcacctgtaatctcagctactcgggaggctgaggcaggagaatcactcaaacctgggaggcggaggttgcagtgagccaagatagcgccatcgcactccagcctgggcaacagagcaagagtctgtctcagaaaagaaaaaaaaaaaaaaaaaattgtccaaagtcacagagttagtaagaggcaaagccagaatatacagtctcgggtctggacttgctgataaccactatgctctacactttcacatctgtatttcccatcacaaatactagctctatcacaaaaatctctgtttatactttggtaatttgtgatgttgactattatttactgatactattttcaagaatgtcattggatagaaatacaaacatgcaactgagtaaaaagcaggacacaagaaatcaacacagacagaaattacacctctacaaaaagtgtacatataaactctgccaggtgcctggagcacaaagatggacaaagtgagtccagtccctgccctgagaaccttggtccagtgggctcagggtgacgctcatcaggcaaaccggaaacacagggaggacgtgtgtgggtgctgcagatgcccaggcagcaatccagaacccactatgctaaagccactgaacataggcaaaaagttttatttaacatatctattttaccttaagatttaaggataacatctttctggacatggcaggcatctatctcaagctccacacagccaaaataaaactccttattctcacaaccctttaaacttactcctttctcaagcagtattttctatcttaaaggaaaggcaagcctggctgctgaagcaataaatctgttatcctcaattccagctatctccctccctccctccttccttcctctctctctctcacacacacttacatgtgcatgcacgcaagcactcactccctcacatgcacacattcacacgcacacatacacacactctccatccgatctatttactgcttttcaactggatctttctcttcttcaggtcctcaagtcaggcctacaacaatttgtttcctaactactcttcctgtttatttttaatctcccttactgcaccaactatctctcttccaataattctggctctagaattatctttctatcatacaaacctgactctatcactccactttttaaaaacatttggtggtttctggctgggcatggcagctcacaactgtaatcccagcactttgggaggccaaggcagacagatcacctgaggtcaggagttcaagaccagcctggacaacatggtgaaaccccatctctaataaaaatacaaaaattagccaggcatggtggcgcacacctgtagtcccagctcctcgggaggctgaggcagaagaatcgcttgaacctaggaggcgaaggttgcagtgagccgagatcacaccactgcactccagcctgggcgacagagtgagactccatctcaaaataaacaaataaataaagtaaataacaacaataaaaacatttggtggtttctgatcatctctacaggatcaagtctaactctgttatggcacacacacacacacacacacacacacagacacacacagctcttcacaatggggtccaacaggaccttccacatcatatctttcttcattcaacaaatatttatttagcaccaactatgtgtcaatcactgggctaaacggcagtggtataatgggaaacaaaaagagagagctcctgctctcatgaagctcacagtctaggacaagaaacagaaatcaaccagtcacacaaacaaatgtttaagattacaactaagacaattactgcaaagaacctccaaataaaataatctgaaattagacagtggcaatagttgtctcgtgcatatactgaaaaccaatgaactgtacacattaaaaggtgaattttatagcacatgaattataccatatccccctccccagaaaaagacacggcagggtgagcacctctgatggtggagttggctaaggcagagacggtgaaaactttccagaggaaataacagagcttacaaataacatatttactgagcatttactacatgccaggcaactttcaccgtactaatgcatctgatcctcctaccaacaatgtaaagttactattatgctcaactcagaggtaagtgaggggtcaagtaactttaaggtcagagagcccacaaatggcaatgccagcatccatatttaagcagaataaagtgagggtctgcactcttacctgctacagtaaagtcacctaggcaatgactattactcagaactacttacgatgcaataaacacagaccactgtgtttcatttctttttctttttttctttgagacagagtcttgctttgtcacccaggctggagagcagtggtgcaatctcggctcaccgcaacctctgctcaccgcaatctctgcctcccaggttcaagcgattctcctgcctcagcctcccaagtagctgtgattacaggcacgtgccaccacacccagctaattttttgtatttttagtagagacgggatttcaccgtgttagccaggatggtcttgatctcctaaccttgtgatctgcccacctcagcctcccaaagtgctgggattacaggcgtgagccacagcacccagcccactgtgtttcatttctgataaaagaaatctctcgccgggcacagtggctcacgcctgttaaccccagcactttggggggttgaggcaggcagatcacctgacgttgggagtttgagaccagcctgaccaacatggagaaaccccatctccactaaaaatacaaaattagccgggcgtggtggtgcatgcctgtaatcccagctactcgagaggctgagtcagaagaaccccttgaacctgggaggtggaggttgtggtgacccaagatcatgccactgcactccaacctgggcaacaagagcaaaactctgcctcaaaaaaaaaaaaaaaatctttctatctcctttgtcattacaatagcctctaaggccctacaagatcaatcctacactactctctccatcacctgacttcacctcctccactttcccccttactcactctgctccagccacacaggcctacttttgtttctccagcatgctgggcatgctcctaccacatggcgtttgcattttcttgagctatgataattacaatcacaacatgtggcataaatcatgattctgctaaaacctcagttaacattttctctaaacacatcaataatgccactaacaagatcttgtactgaactgtacactaatatttcaaatgtcataaattttaataaaaactacctaaattttccagttttatattgttctatatgatatcaccaaagattcttattttacaaaatccagtaacagcagcttttgcttaccaattagtctgaacaacagtcatatagctatctctgcagtgaaataaagcaaagcaatcaagccaagaaagtgtcacaatagaatctgattaccaccattcctctgtttagccctagaaccacagtttgtgaaataactatgacaacagcatttcaaggcaccaaaatcccaccacacttttgctgagaaagtattctccatctgtgcaaacacatacaaacgcatgttgacaaccagttatataacttcaatacaataacccagtgatattttaagttcttattttgctaaaaatcctaagaaactgttaatcctaaaaccgttcagagtaggatgctgagaaaggaatgaagaaaatacatttaacacatttacatttaaaactgagttgtccctaaactccaggtggaaaaaactacctctttttggcagggcgcagtggctcacgcctgtaattccagcactttgggaggccgaggtgggcagatcatttgaggtcaggagtttgagaccagcttggccaacatggtgaaaccctgtctctcctaaaaatacaaaaatattagctgggtgtggaagcacatgcctgtaaacccagctgctttggaggatgaggcaggaaaattgcttgaacctgggaggtggaggttgcagtaagccgagatggcacccctgcaccccagcctgggcaacagaaggagacttcctctcaaaaaaaaaaagaaagaaagaaaagaaaagaacattattgtgtattttgaaacaggagagccactgaaatgttcccaacacatggaaatggtaagtgctagaagcaatggatatcccaaataccctgacttgatcattacacattctatgcatgtaacaaaatatcacatatacctcagaaacatatataaacatattaattaaaaattttttttgccagcagcagtggctcacgcctgtaatcccaacgctttgggaagctgaggcggcatgtcacctgaggtcgggagttcaagacccgcctgaccaacatggagaaaccctgtctctactaaaaatacaaaattagccaggcatggtggtacatgcctgtaatcccagctactcgggaggctgaggcaggagaatcactttaacccaagagatggaggttgcagtgggctgagagggtgccactgcagtccagcctgtacaacaagagcgaaactctgtctcaaaaaaaaaaattttttttaggctgggcgcggtggctcaagcctgtaatcccagcactctgagaggccgaggcgggcagatcacttgaagtcaggagtttgtgaccagcctggccaacgcggtgaaactccatctctactaaaaatacaaaaaaattagccaggcatggtggcgggcgcctgtaatcccagctactcaggacgctgaggtgggagaatcgcttgagccctgtaggcagagatggcagtgagccgagatcacaccactgcactccagcctgggcaacaggtcaacactccaactcaaaaagaaaaaaaaagaaaaaaaaatttttttaaatattgtcctgtctttggtgtttgtttactgaattaggctgtaaaatcaagcttatcaagtcacctaattcttaattaaaaaatagtagcaaacatttactgagctcttactatctgctctgtcataaaagatgcttcggaaatgaaagagtttactagaagcctgccaaaacaagtgtcaagttgcctcaacctttgatgaagcgaatatgaatattagagaacttcatgcaagtatctgctataaatcagctactggaccaaccataaatgcctgaaaattaccacatccacctcattttacagatgagaaactgaggcccgaagagactaagtccaaaggtcctcactaacaagtaggagcaagaaccctatttccagttcagggttttgttgtcaattacgtgttatttgtttatttaaaaaagagaaaaacctattctagtatctcaaaatgcttctacatagttgggaagaaaatgaatacctagaataagtaaatatttaatgaaagctaaatactgaaaacaaattaatgtcatccctaccctgcagtaaacatgctgaaagggctcctaggacagaaataagtagaatcatagccacacttcacagcatctagtagaagttaggtgccccattgctaacatcaccaaacaccaccaccagagtgccttctttttttttttttttttttgagatggagtcttgcattgtcacccaggctggagtgcagtggcactgtctcggctcactgcaacctccgcctcccaggttcaagcgtttcttctgcctcagtctcctgagtagctgggactacaggcaccctccatcacacctggctaatttttgtatttttagtagagatggggttttaccatgttgagcaggctggtcttgaactcctgacctcaggtgatctgcccatctcagcttcccaaagtgctgggattacaggcgtgagccaccataccaagcccagagtaccttctttatgaagagaaaacacttcagagctacagaacagttcttgactcgtcgatactcttttggaaaagaaaaagtatgctggccgggctcggtggctcacacctgtaatcccaccactttgggaggctgaggcaggtggatcacctgaggtcaggagttcaagaccagcctggccaaacatggggaaattccacctctactaaacatgctaaaattagccaggcatggtggcatgcccctgtaatcccagctccttgggaggctatggtgggagaattgcttgaacccgggaggcggaggttgcagtgagccaagatcgcgccactgcactccagcctgggcaacagagtgagatcttgtctgaaaacaaacaaaaaaagtatcttaagcaacattccccacatatatctcatctatgcacgaaaagttttactagctacaaaacgtccacactctttcaaaaagaaacgatgctgagctaggtgcggtggctcacgcctgtaatcccagcactttgggaagttgaggtgggcagataactggaggccaggagttcgagaccagcctggccaacatggtgaaaccctgtctctaccaaaaatttgaaaaaattagccaggcatggtggtgtgcacatgtagtcccagctactgtggaggctggggcacgagaatcacttgaatccaggaggcagaggttgcagtgagctgagatcctgccactgcactctagcctgggtgacagagcgagactctgtctcaaaaaaaaaaataaatcatgctgaatcaaggcagttttcatcctttctataatctaaattgggctttccatttttactaaaattcttacttctatcaaacttgtaaatgctttcagggccagatcttagggactaaacaaaaagtattatttaaatggtaccattttttcctgggaaaacatttttaaaatgtcatccattgataaaaaggtgagtgactaccaataacaacaacaaaaaaatactattttcataagggaaaattccaaaatataatttagtttagaagtggaaaggacggcagagcgcagtggcatacgcctgttatcccagcacgttgggaggctgaggcaggcagatcacaaggtcaagagatcaagacaatcctggccaacgtggtgaaaccccatctctactaaaaatacaaaaattagctgggcgtggcggcgcacgcctgtagtctgagctacttggtaggctgaggcagaagaatcacttgaacccaggaggcagaggttgcagtgagccgaggtcatgccactgcactccagcgtggcgacagagcaagactccgtctcaaaaaaaaaaaaaaagtggaaaggccaggtgcaggggcagaggggtggctcacacctgtaatcccagcactttgggaggctggggcgggcagatcactcaagctcagaaattcgagaccagcttgagcaacaaggtgaaaccccgtctctactaaaaatacaaaaattagccgtttgccgtggcgtgtgtctgtggtcccagctactcgggaggctgtggcatgagaatcacttgagcctaggaggcggaggtcgccgtaagctgagatcgtatcattgcactccagccttggcaacaggagtgaaaccctgtctcgaaaaataaaaaaaaaaagaaggtggaaagtcacagcactttgtacgacagcaaatagaagacttctacagagatttgattgtgtcagatgagaatttggccactcactctcatttattctcaacagctgagagactgggcactgtagtacaccatgtgattaattaaaagttaccacatggccgggcgcagtggctcatgcctgtaatcccagcactttaggaggccaaggtgggcagatcacctgaggtcatgagttcaaggtcagcctgcccaacatagtgaaaccctgtttctacaaaaatacaaaaattagccaggcaggatggagggtgcctgtaatcccagctactcaggaggctggggcaggagaatctctcgaacctgggaggtggaggttgcggtgagtcaagatcatgttgcactccagcctgggcaacagagtgagactctgtcacaaaaaaagaaaaaaagaaaaaagttaccacgacattatatactaattgccaattttcaaataaaataaaatatactctaagcctatgttgtccaatatggtagtcactaagcacatgtagctactgagcactggaaatgtgctagtctgagctgaggtgtgtgctgtaaaatgcaaactgtcaccggattcacaccagatttcagacacttagtaccagaaaaaatgtataatatctcattagtggttttttcatattgaatacgtgttaaaataatattttggatatgctaagttaataaaaggatactactaaaattagtactttttcaacttgtttcatgtagttaccacaaaatttaaaattgcatttgtggcttgctttacatttttattggacagtactgctctacacaaactgcaaaatatgacccaacgttcctttgattcatcatcatcatgatgaataccaaatatacaataaatcgagaaaaatcttatttacatttttggatagtttaaaatattaccaagtaagaatggcatttctgaaaactcctactaaatttacaaccaactccaactgtgttaatagaggaaggactcagtcctacaagtagtatttttagggatcaaaaaggaaatacaaaagtaaaagccatacatgagagtctaagagaaataccatctgtttctaaaaggcatttttaaacaaaagcggtgttttaaacaggtaatagacctgtttttttaaaaaacagtattttattgttttgagaaatccgaagaaatgccccaattcccagctaaacaaacctcttaaaaaggaaacctgtgaaggtaggaactcaaaactctactcccgtggaatagaggtaagatgtctgaatgaatcatatggaaaatgtaagccaagtttcttagcaggatatttataattaaacattatacaacgacgaagccagccaaaatttttctagatatccttcaatgccaccacagtatgaatgcatcaatcaactattacaggatttaactaaaactactttcaaaattctgaaacaccataatgcctttcatcaaaatctagctagtgagaattagggagggaagtttccaaatgccttatcttataaagttagaaattgaaaattcaaagccatattaagaataataaatatttgtatgacattctgttcaaccatcacttttggatacatcatcctatttgatcctcaggacagcgctcagatattggtacatttttatccctactttagaggtaattccaggctcaaagaccttgacttcttcaaggtcacatagctaaaaagtggaagaaccagcgtttcaccccagatcttctgatgctcatccaattctctttccattacaagacaattattcatttaaaaccaaatgtttagaaacccaacaagtctgatgctaaagaaagacctaaggatcaagtagatcaaaccttaagacttggaaaacgctgaaagccggctacaaaacatgctggaatccgttaaaaacggggagaagagattatcaagagaaaggaaatcaaagaggaagaagggggatctaatctaaatgtccttgggtgcagcatagcagaatggcaatattcaagtagagaatgcagggaaactgcactttcctgtgaaatgtgattttcaacgtagtattgtaggttaaaaaaatgactgtgttactttactataaacgtgtttgagaattttacttacgatataggcgctcagaaaaccaatacctctccaactgggtacaaccagtcccacattttttcataagtcatgatgcttacctcccaaaaagccaatttttaaaaatcagaattcagcatcccctcctattcagattataggtaaagggaagggtcggtaggacgatggcaaatctaatggccaatgtctttctaggcgaaagcatccttaagggcaggacaaagacaccaccactacaaacgaacctcgttcaaccttcagaacacggagaacaaaccagttaaagcaaaacgaaccaacattgcagatacgggaaaagggaattcctaagatggctctccaaatccgtgcactcggcacctttcctcagtacaaccgcgaaggctacgggaatgcgcctgcagagtgtgggaactccgggcgcgggtgcccaccccgccgactcccagggcgaccccagaacgttcgtttcaggcgggtcacagctgcgccacccaccagacctgtgccccagcgtccgaccgcgcacctgagaggaccgaggagatgaccggccccaaatgcatctgcttctccccgcggccgcggaggccgagcaggaagggcccgcaggcggccccggccccgcgctgacagcccggcgccgcccccacctgcccgcctggggggcgccgcggccgggcgcgcccgcccagccacttccttccccgcccgcccggcctcgcaccggcccgcgggggctgggagccgcgggaggaaggaggtttggccagcggcccgcggaggaagccgccgccacctcccgcccgccctcacccaccggcatcatcgcggggagagtccgcgacgccctcggccgccgcctgacaggacgctccgcgccgagctgtgcccaccgctccggccgcctcctaaggccgcgctcccgccgccgtgctctccggcccggccgcggcgaggcggcagctgcggcgggctgcggggctctcgctggccctgtcgcggccgccggcgcgctgcgtcgctgtcccgggcacccggccgccgccgccgccgcctcaacctcagcctcagcctcagccccagcccgacagcctgcggcccgcccgccc

SEQ ID NO: 1267 - DNA, 124189 bp, Homo sapiens
gttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtaggacgcgggcggggcggaggcggctggagggcggccgggcgaggcctggcgacgagggcacgggccatccagatccttctcgcgagcccgtgccctctcgcggggctccagggacccctgaccgtccagggcgagtggtcactacacaacccgacgcgcggcccagagcggtgcctgtaaggaagctgagctagaggtttttttttttttttttttttcagttcttaatgtttaacagactagtttttgaggcactcaggttttcaggataacggagcggagggcagaggtcccataggccccttccctcccagagtttcccctgtgagcatctgcgtaaggtgtgggtatttgtgacagtcggcgaacctgcatcgctgcgtcttcgtcacccggaggccatcgttacaggagggttcacgcctcgtactggacgttctgtgggtttggacaaacgcctaacgtcacgcattacagagttcactgacctacagatcttctcggccccactgttcctgcctccctttccctacaccacgtggaaaccactgatttttttactgtctccataattttgcttttccatactgtcatctagttggaatcacacagtatgtgtagcctttttgatgggtttctgtcacttagtattagtatgcatttgggggttcctccatgcctttccatggtttgatagcttctttccttttagcactgattaatattccactgtctggatgtaccacagtttatctccattcacctactgaaggagagcttggttgcttccaagttctccccccaccccccgagatggagtctcactttgttacccaggctggagtggagtggcgccatctcgcctcactgcaatctccccctcctaggttcaagcgattctcctgcctcagcctcccgagtagctgaggctacaggcatatgccaccacgcctggctaatttttgtatttttaatagagacagggtttcaccatgttggccaggctagtctagaactcctgacctcaggtgatctgcccacctcagcctcccaaagtgctgggattacaggcgtgagccactgcgcccggcctgcttccaagttttggcaaggtttttgtgtggacataagttttcaactcattgggtaaataccaaggagtgcaaatgctgaatctttgttaagtttcacagactccctcctcatctcactattctttaagtagctaccatcagttactctgttcacttgatttgggtggaaataaaaagcaagagtatatcctctgtttttagaggaaagacgtagatttggtgagtagaaacacctgctccctcttctcgctctttaaaaaggccctgggagaagtacttccagcttggagtatctccgtcactcttgctcagtccccaagtccagcacgctttacagttgagaaggtggttttgtttttctttttcttggttttttttttttgagacatagtttcgctcttgttgcccaggctggagtgcagtggcgcaatgttggctcaccacaaacctccgcctcctgggttcaagcgattctcctgccttggcctcccgagtagctgggattactggcgtgtgccaccacgcccagcttattttgtatttttagtagagacagcatttcaccttgttggccaggtcggtctgaccttgtggtccacccatgtcggcctcccaaagtgctgggattccaggtgtgagtcaccgtgcctggctttatttttcttttttaaagttactcttgtttgttagtcttgtctgatttgatggataggcccagactctgggtcaagctttcgtgggttgcttcaagcctttgtagagttctttcaagtacacctttgggatctttggtaaatttggttcttagaggcataggggggaccgagagaccccttgtgcaactttggagttgctgtttgtatgtttgcacactttacttccttgagctactctggtaaatgatcctgtgggccgcctcccctacttaatggtccatcacttactccttagttttaacggtgtgaacagcattgctattaaataacccattgtaatattggaagtaaattattattgaccttgtcagaaagtatagatttaagtgccattttaagcactaaggacaagtttttaagatttctagtccttcatggactgagacttttataaaatcaataaaaatgaattttcagagcaatgaaatgaaaaaagacaacatactaatcgcagttaaaaaattattagattcaatctgggtgtggtggctcccacctgtaatcccagcactttgggagtccaaggtgggcagatcatttgaggtcaggagttccaagaccagcctggccaacatggtgaaaccctgtctctaccaaaaaaaaaaacaaaaatttgcccagcatggtggtttgtgcctgccgccccagctactcaggaggctgaggtgggagaattgcttgagtccctgaggcagaggttgcagtaagctgagattgtgccactgcactccagcctgggtgacagaatgagaccctgtctcaaaaaaaaaaaaaaaattcaacatatgtaaaattactttgtgaaattgatgtaaacattttaacttctgtatttaaccagtgacaggcaatgttggtctatgagtagtgctagttttgatgaaattcttctggaagtagcttcctgggctctaggtgcatatgtattcaatgccagagtttccagcacgtagcaggcactcagctaaatatagctatattattgaatccgcacaacaacactttgaggttgatggctttatcatcaactgattctttcatgattttgtagatgaagcaataggttttggtggtaaagtgacttgcccaacttcctgtagcaaatggtggtgatgggaagaatgactcccccaaagatgttcactggaacctgtgactatgtaatgttacatggtgaaagagatttcgcagctgtaattaaggttacagatcataggacaggaagattagctagattgtctgagtgggcccagtctgatcacatgagcccttaaaagcagagaactttctcaggctggagtcagataaatttgaaatgagagatttgaaatatcattgctcggaggggccacatggaaagcatgagaatggaatatgggcagctaggagcaaagactggatcccacttgacagcaggtaaggaaatgggtacctcagtcctacaattgcaagggactgagtttgcaagggactgatcctacaattgcaagggcctggttttggccaacaacctgaatgcactgccagtagggaacgcaactctgctaacaccttgatttagctttaggaaaccctaagcaggggatccagttgagttcacctggacttgtaattaatttgccttgtttgaaactgctatgtttttgcgatttgttgaggcagcactgcattagggtacaaatctggtggcagagctgggttcggattggggtgagccgacctgtgaaccccgcacggtgcctggcacatagtggatacttggatacttgttgaatgttatttttcccagtgaaggagagtgttgagtgaggcattgacattagtgagagaacatttgacataggggagggatggctttttttctttttgagacggagtctcgctctgtcgcccaggctggagtgtagtggcgccatctcggctcactgcaagctctgcctcccgggttcacaccattctgctgcctcagcctcctgagtagctgggactacaggcgcccgccaccacagccggctaattttttgtatttttagtagagacggggtttcaccgtgttagccaggatggtctcgatctcctggcctcgtgatctgcctgcctcggccttccaaagtgctgggattacaggcgtgaggtactgcgcccggccgggagggatggcttttataagcatagggtattgcacagttaaaatgtatttgttagagatagtcactcaatggtaaaattagtgtacaccaagtcactgcagtccggtctgagagagtgttgttaaatcagcttaatgattaaatcagcttaaatcagcagaagaacatgggcaattttttttttaatcagcttaatgagtagtgaccaccagcattaaaaaataaatagaaaatgccagactacatcataggtagttcagacaagaattgccggagatggtgtgggcgcctgtgggtcccagcatgaatcttgctcatgctgaaggtgagtaacaccttactcacgatgaaggtgttgccggagtgcctgtggggaacaatttataaattttgtttccagtgatttttacggatttccccatgtctcctcttccacatggtactgtattttactctttgatggtgattattctttctgttatccttacattctcgtgtcttcaccttggcatatgaagaagaaaacctcagtggctgtgatataccattttgagcattctccagtgtgtagcaccagctttcctgtggattgcagcccatggctgggagccttgcgtcactcccagcttccttctgccttgtgtttctttgtgctttctgccgtgtactttcctgtcttcacagctcacgttaactcctggctcatgaagatcttacttaattctcgcttttgtgtctttgactgttcaacaccttattaaaatgttctttgtctttgggaagccttcatcataggaagctttcagatttccactatctggtgattactttcttctagttccctaatttattttattttatttcattttactattattattttaaaaaatattatttaaaaaaacagacagggttttgccatgttgcccaggcttgtctcaaactcctgagctcaagcaatctgcctgcctcggcctcccaaagtgctgggattacaggtgtgagccaccgcatctggcccaggtccctaagtcttggtttttgcacttgtctcttactgaagttgaatgcctgctgtattgggcattgtgtcaggtgacacaggaaatgagccgtctcggcccttctgacagatgggggaagttaagatcagagaagttgaagtttactttgtcctaagtccacatacctattatattgtagaatgggtgtgttggactccaaggcatgttgcttttttctttttgtcttgttgccttttggtattcaggcctcacatagatgttagtgtatgactctgtaactctccaagaattcctattttctgttcacccacaaaatccactttttttttttcttgctctgtcacccaggctggagtgcagtgctgctgtgcatagctcgctgcagccttgaactcctgtgctcaagcaattttccttcctcagtctcccaagtagctgggactacaggcacgtgccagcatgcctggctaatttattttttgtaaagatggtgtctcactatgttgcctatgctggtgtcaaactcctgggctcaagcagtcctctcctctgggcctcccaaaatgctgggattataggaatgagccactgccctggccaaagtccacatttttaagaccttttggtcgtttaacagatttcatttattcagtaattttcccattgattaaaaaagtgctggtgcatgttctctgtatgtactatgtgcagctggagtagagtgtttgaaagggagagaataggtgtggtcacggagctaacaggagatcaagaggtatgtcctagccgagcacggtggctcatgcctgtaatcccagcactttgggaggccgaggcgggtggatcatgaagtcaggagatggagaccatcctggctaatacagtgaaaccccgtctctactaaaaatacaaaaaattagccgggcgtggtggtgggcgggcgcctgtagtccccgctactcgggaggctgaggcaggagaatggtgtgaacccggcaggcggagcttgcagtgagctgagatggcgccactgcactccagcctgggcgacagaggtgagtggattgaagtggggcaaggacaggagcagggtggtcagggaagaatctcttgatgtcctctgtgatggttaactttgtgtgtcaacttggctgggtgacagtgcccagatatttggtcagacactactgtggatgttttttgaaggtgttttttagatgagactaacattgcaaatctgtggactttgggtaaagcagttgatgctccttgaggtaggagggcctcgtccagtcagttgaagacctgaatgcagcgaagactgattttccctgaccaagaagaaactgtgtcagccgactgactttggactcggactgcaaccctttcctgggtctccagctagctggcctatcctgcagattttggacttgtacctctatagctatgggagctaattccttaaaataaatttctttctccacatcttgttgattctgtttctttagagaactatgactgacacatcattcaagcaagagataggatggtggcttagaccaggcaggtagctgagagtggaggatgtggggtgtggtaagcaatggtggcatttgggacatgttcttaagctagaggcaaggactctgtagctggagcaagtgtaggatgtgagtgggggagcaatcacaggtgacaccaaggtttctggcctagcaagtgacaggtgttgccttcaggtaaggaaggcgagactgcacgaggaattagtttgtggggggataccaggattgattttgaacatgttcactttaaaatgcctgttagacagcagtacatgtaggtggtctggagttgaggaaggaagtctggcagagctagacactgggaagtttaacttcgagaatgatgagatcccttaactaggatgtatcctagtgagtgggtgtagagagaagggcccacctggggtgcttcagtgtttataggtggatgagttgcagtgagaaaaggagactgagaacaagtggtcagagggacaccaggtgagtgaggcccactttaatcaacagcttgcttagtgccctgcacacgcatatcttaacactttcatgggaatgattttgtatattatttttcccacataagaacttattaagggtacagattatcagggaatctccacctcttggtgcagtacctgacatagtaggaactcagatatttgtttgaatgaatgacctaggaggtcacaataataataataatttttttttacaagagggagggcagggcatttggtgagtagataagtgtggcagagtgatgttacctatttaccatgtgaaaatggaagcaaggtaattactggtgataattattattttcagatggggtctccctctgttgccccacatggaatgcagtggcacaataacgtttcactgcagccttgacgtgggctcaagtgatcctcccttgatcctcccaactcagtctcctgagtagctgggaccacaggtgcatgctgccatgcctgacaaattaaaaaaatgtttttggagacatgggatttcactatgttacccaggctggtctcaaattcctgggctcaagtgatcttcccaccttggcctcccaaagtgctaggattatgggcatgagccaccatgctcaacctaggagaccccagttattgaatgcttacaatatgtcatgtccttattctagacatggtgagagttgcttcctcatgcagtcctgtcttgattgaatcataaatctctgtcttactcctcaagccatggtggattttcctaaggagtgtatcagagtgtgtatatgggtatacaatcaaacaataaaaatcacaatatcctggcaagtgtacgataaaatatttccagaatatgggtgcttctcacagtttacatagtcaccactctagaccaaaccactgctgtcatctcttgcctggattattgcataaaccttctatgtttggtctcctgacttttcaaccttactccccagtaatctagcacctagaagaatgcctggcatgatgtagatgcttagttaatatttgttgaatgatggcctggcatagtggctcatgcctgtaatcccagtgctttgggaagctgaggtgggaggatcacttgaggccgggaattcgagactagcctgggcaacatagggagaccctgtctctacaaaatattaaaaaattagccgggtgttgtggtgcctgcctgtagtcccagctacttggcaggctgactcagaaggatcatttgaagccaggagttcaaggctgcagtgagctatgattgcaccactgcacgcctgggcaacagagcaagagcctgtctctttaaaaacaattgttgaatgaacaaattcttgagtaaaccttcacacctgaggttctttgagcacatgtgtgatctcctgtggcatcgactgctgttaggataaaatttcatctgactctgcatctaggcttggcgagcgttcctccattgggcatctccttgtctgctgctctcgctgtgctctggtcacattggcattttttctgtgtcttgaagatagcaagctaattcccaccttgcagcttccacactgactcttctgtattcagtgcttcccgtcgctcccttcccattgcaggctcctttcttcatttgggaccctgttcagatacctccttagaggagtttcctgtgacctccgtagctaaagcagccctcccctcccttctttcccagtctctctagtcttttaaacaactttttaaccttctccaagtactgaactcctgcctccatccagtcttgtttgtgatagccaaaacccagcccttccagttacctttggattgtgattgtgtttttggcccctcccccatcccaaggggggaccagaatgattctgagatttctggcttgtagagttgagtacatgggtggtgctgtcatttactgagatagaaaatactagttgatgaaatgtttgaagaattatgcttttagagggtgtgtgtgtgtattggtactagctggttcctttcttgaattctgtttgttcctttagaacacaaaaaattctctatgactttggttttgaacatgttgattttcttttttttttaattttcttttttgaatggagtatactgaaggatgaacatgttgattttaagttgcctgtgagcatccaagaggaggtgtcacaggcaattggttctgtgcatttggagctcagagctcagttggggaagggacacggcagcctggatgtgaatctcctctctgccaatgagcaagccattggacgtatctgaggcagtttgctcatctgtcatatggggatagtatcacctactttataaggttacgatgaaatgagaatgcactcgtagtgcttagtatgtgcctggtgtgtaagagaattactttaatattattaaatggattgggctggctagtaatgctacctcgagagcctattatatgtcggggattgtgcagaatgcttttatgtggattcatttattctttctattccctagctaaatattgtagctcctgaacgaatgctgctttttcttgataaaacacacctgaaacattccagtcgtccccttcccacctgtgccccatatatgtgtgtgtgtgtgtgtgtgtgtgtgtgtgtgtatatatatatatatatatatatatattttttttttttttttgagatggtgtctcgctctgttgcgcaggctggagtgcaatggcgtgatcttggctcactgcaacctctgcctcccgggttcatgccattctcctgcctcagcctcccaagtagctgggactacaggcgccagctaccatgcccagctaatttttatatttttagtagagatggggtttctctatgttggccaggatggtctcaatctcttgaccttgtgattcgcccgcctcggcctcccaaagtgctgggattacaggcgtgagccaccgtgcccggcccccctttatattttcaatcctgattcctttgccagctttaggtattataaatagcctagtgtataaaaacatggatctgtcactattcaggaagttatttgtattaaaatttctatttgatttataggttttccagaaataactacagttttaaatgacgtataccaataccctcacaggatatgagtattaggtttgccaacaacaaagtgagagatggaaactcaaaacttaatatatttttcctttcttttttcaagcttgggtggaaaattaattaattgcatgtgggtgacttagagtggctaggattcgttttcatcctgaactgtccatagctgcttcagtcaccagaagctttttgccgggagttatttctccctgtctgaatacagaggatgaccctctcttggaagtggtatggtgttgtccagtggctgcttgaggagccttggagagtgaaggaaatgatttgcatctcttcatggcatatatttcctggtatgtatggtgggatgaccaattctagtaccgggcttcatatacaaacttcacgttctccttgtttctttaaatgaaaattttgttctcaccattaaggcactgatattttcttaaaactcacgtttgctacttactgtattcactgcacaataagcagttgtgtacttttcggggcatttatctctcccacacacagtttccactctaggaaatcttacagtgactgaagaagccaaaggtagtatgtaggaaaactgaaaatctcagagcaggaatgagaggtgtctttattttaaatctgcttgggactgtgtttgtcctgttaaaccctgatcaggtgggttgcattacgtgattgggatttaagaccaaatagaggtcagttgaaaatggtacacaagttggccaagaacgcagggagaataaagttaggagggtttttttttttttttttttttttttttgtggtgtatatttagttctagtctttttgaaaaaaagtgtttttttttttttttttttttgagacaaggtctttctctgttgcccagattggagtgcagtggtgtgatcatagctcactgcagcctttaactcctgggctccagtgagcttcctgcttcaacctcctgagtagctgggactacaggtatgtgccaccacacccagctagttccaattttgatacgtatatttttttctttttagatgaaagaaaaccagtaaatcttcaaatataaagttataattaggttccttggacttaactttaagaatgaattgtatcactttataaaaaaaatctgactaatgtataatttcctacttttaataaagttatgaaaagccagattttgtatattaaatattttgctatttcaccagagtataagtttaaattattcaccaacagtgaatgtttttctttgagagtagcagctactcatgttgctaaatcagtctatttatctttactgatagagctgagttttattacacgttcccttaatgttgagcttaaaagtactgtgattaaaaccaaagctgagcgttgggttaaagccctgcttcatttttaaactgcatgatattttttccctcaccgcccttctccccatcccctgctgagaatgatcgtataatgggatgttgacttctcatttctgttatgttgtaaagataggattcgtattaataatttatttaattctatatgtagcttcattgtagaataaaagtcaaggttaatatctaagttttgtacagaatttgtcagacttcatactaaagttgctttagttcctgtgaggtgggtttgaggtataagaaaatactgcaaacattttttcaaaatacttaggaaacattttagttaaaagcatactattcaatgaaaacatagcatgtttagagtggttaaaaaaagaacactatttaaaacataggctacatccacaggatactgaccttgtaacaaagaaaaacttgaagtcacatcactttttcttattcttaatattaggagttctaaggtgttcataaaaacccctctagttgtaagtaacttaactagatgggtgataatatggtaggttccatattctgtgtgagaacactgggaacctgtcctttgtgtttttgtctacgtaactggaaatggtgggtatttcatctttgtctgccctcttggagctgtcaccttggatcacagaaggagcagagcagtccatgctccctgagtcctccaggtcctcttgctcactccctctgtcagagctgcttaggaagtctttcagaacttgcttgaagatgtagactatttcccatggcagtacatcattttctgccaaaacttctcgaaatctagaggggaaatggtaatgaatattcagtttagaacattttttgttatatctctttatctccaaaatacagcttgaataatgtatacaagttacccaccttttgagtattttgcatgttgttttaaaattatgcttctagtaaagaaattttaaatgtaatttaaaacaattgctcaccagacatctacacagttaaagaatttacatgatagaatacagtttctagtcaaaatatatgaggaacttggacttagcagtagcaggaatcataagagaacatagtatttttacctgctgagaatagttccagtttggcaaggttgaacttgtgagcaaagaacttcaagttgtctttgttcagtcactgggatagttgtgtggggattctggtagtttctgagccagttgtaatccacacctgtttttttcactttttgttcattttcgatttcttgtattaatctctctcgctcctttaggtgccattttaattcccgaagcagagtctttgtcactatgtctgagccaggatagtgtgtgggtttgtaggaatcgtttttgggccatttcatccagccaaaaagtggcatttttagcctatggaaatattttcacttgtttatttgctcaaaatgttatgttcttctgagcaaatatttgtttctttacaataaatttgcccgaaaagtgcacgattttttttcacatttagctatgcaggtcaaaataagattagaacatggattaacgtcttaatttttaactaggtcagtggcagaaaccaagctttgaaaatgcttttatgtagcttagcagaaattagatatacaaagtcagagataacatatagactgaatgatatccgaaaataacactaacacttgctgtgaaaagttcttaagagacttaaaatattaatgtcggggcaagtgctgcctacagatacttttgatttatgttttggacagaaaaggtttaaagcttacctgttaagttgatgggctgatgtgatgttgccaaagagttgactgaagttggtgacgaagctgtgtttcactgggacgtatcttgctctcctaggtgtgtcctctgtagaaggaatgcgccaccttatttacccaccgaaactgtatttgaaataaataactttctgtgttaggaatgaggctgtgatgtcttcatttggagagaatgctcattaattcaccttgtaagtaagctagaagaaatgacaaaaataactgactatttaatcttcacaagttatataatggtctgccttttcaatgtagctcagtctatttgaaaaaaatgccagcagctatagatgctggtcctaaatgcattccgacatgtctttggtagtgaaacgaagaatggtcgtctaaagcaccatagatgcgctccgagctagagtgaagactgtcgcgtgatgtgatgctttgctgtgcatagctgtaggtcacagtttagtgctgtatttttatgcctgtagagctctaaaaatagccacgttgcttttattcttcagcttaactttcaggccatttggaagccgggtcactgtcccctctagtgaaaacaggaaaaatagattagacttgactatttgcaaaacatacattctgagaaaactcattgtaattgagtgaaataggtaaagaatgctgatgtgaattataattgtgaaatatttagcaaatgttacattttgtattcattttggttttttcaaaatagttaaatttgtatatttaagcaagttgaaatgctaggggacataataaacagctagataactttaaaatatactttataatctctgaaaatatggtaataaggcagtaattggttgtcagggaaaaatagaggcataagaacatacaaaattctaaacaaaatcttataattcatcgtagaaaaatcattttcgtgttttttttttggagctgaggatgaaaaacttatatttactatttaggtgcatattggtttgtaatggtcattattgtgctatttcttttttctttctttcttttttttgagacagagtcacgttgtgtcacccaggctgtagtgcagtggcatgatcacggctcactgtagcctcgacctcctgggctcaagtgatcctcccacctcagccccctgaatagccaggaccataggtgcatgccaccacaggtgcatgctacggcatgcctggctagtttaaaaaaatatatacacacgcacatatgtacatacatatatgttttatatatgtacatatgtgtatgtattttatatatgtacatatatgtatatatacacataagtatatatacgcatatgtatatgtattatatatgtatatataaatatacacacatatataatacacacatatatacacacacacatacatttcttttttttttttttttgtagaaataaggtctccctgtgttgcccaggctggtccgtaaactgggctcaagtaatccacctgcctcagcctcccaaagtgctgggattacaggcatgagccactgcgctggcctgtgctaatttcctatgcaagtgtttgtcttttgctaaagagtagatagtataaaaggtcttttactccccagttctctgtgaaacgactgcatagtggttttcccttttatagtatttgtttcttctgttgcttttcctttcaagtgagccatgaagagtagacgttgtttacatcagacttgcatgtcatgcatgacccagagtgacgtgtgtggccaccctacagctcctgttgcttagatgttagaaaaagccagatgtcaggactgattattgtcaactggaaggttttcacatgacattgcatatactgttaggagaaggaaaggagtaaagtttatgatgacagaagtgtcctaccaaattttatactaaaattacagcgaatcttgccgcatactcctttgaataacctccttgttactgcataaatttttttcctctgaaatggtaacaaaaatatcagaacatattggatatggaacttaagccaaatttctgttcaaggccctctgcagtctcacattatccctccttcaaggccctctacagtcttacgttatccctccttacctggcttgctttcttgctcgaccctagagcacaccttttgtttcagccaggccacgttgccccctgacgcttgccatgcttacttctgatccttcagctttggttcaactgttttttctcttctgaaaagctgcttctttgtgtttttcatgtatccacatagtaattctctttttcatggaccagctcaaataccaactgattttttccttcaacctgagggtcaatgtgaacatcttccttggcccttcttttcctttgaactctgattttatttatcttcactgttaaacttatagaaagactggtttggtctgtgtttctgttctctctccaccccgccccccacccttttttttttgagatggagtcttgctctgtcgcccaggctggagtgcagtggcgtgatcttggctcactgcaacctctgcctcctgagttcaagtgattcttgtgcctcagcctccctcgtagctgggattacaggcgtgcaccaccacactcagctaatttttgtatttttagtagagatggggttttgccatgttggccagctggtcttgaactcctgacttcaagtgatctgttcgtcttggcctcccaaagtgctgggattacaggcgtgagccaccgtgcccggcttcttttccctttttcctaatgctttccaattagatcctgctgtgtcctctactgtaattgctggctttcagtcacttaacagatatctattgactgtctgccagggcctgaatagttaggggctggggtgtagcagtgaacaagaaagacctagttcctactcccaaggagccagcctccaaatgtgaagacaaatataagtacacaaatcagtaaggtaattatagatggtcataatctattaatatacttggaacacttctcccacttagaactggaggtcagagaagacctttttgggtaggaggtatccttttaacagagatttagagatcaatgagctagccactggaagagcttcttgaaggcaatcttccttctccacttacttgtttgacacctttcttgccattgaaaccattaccaaagaccttttcagaacttttcttaccaccttaactcacattgagtataccttcctttgaagttaattgtgtaaaccaatttttctagtacttagtgtgtgctacttgccttacagattttattttgtcctgtctcctgagattatcagattgaagtagagacccaaataattctctgattacagtatttcttctactgctgtgtagatagagaacataaatatttgtaagcaaaggtaaggaagtatcttggattgtatttatcttacattataatgagttgaaaaaatgaattgtttctgatgaattgcaaacttcctaggatattttgtgtggacgacataaagcttaagctgttaggtcctttgctttttggtcattgtcatagttttctagtttacaccttgttagctaagtattaaattttataagacttaaaatgaaataggaccgtatcatgcataatatatgtgtgtctatgtaaaattttaagatctgtaaggaagtacataaaaagaaaagtttagaaagacaaaattttggaaccttgaaaagcaagctaaggagccagacataactttttatatattacaatcagggctgctttatatagtattcaacagcacttgattgcaatcaaagaaggatttttcattgtgggaagactcatatctttctgtttttttttttctttttttgagacaaggtattgctcacctaggctagagtacagtggcatggtcatagctcactgcagcctcagcctcctgggctcaagagattctcccacctcagcctctcaagtagctgggactataggcacgtgccaccatgcctgactaatttttaaatgtttggtggagactgggtctcactcaccatgttgcccaggctggtcctgaactcctgggtacaagcaatcctcccacctcagcctcccagtgtgctgggattataggcatgagccactgtgcccaacctgtttttaattcattttgctactgaattaaaagttctgggttattgattcatttttcttaaggtaaaaagtacatttctgtggagttgttcatattaaaaactctcaacaaactagaaatagaaggaaactactagcataataaaagccatatgtgaaaagcccacagctaacatcatactcaatggaagattgaaagcttttcctctaagatcaggaacaaggtgaggttgccgcctttcaccacttttacttaacttagtactagaatttctagccagagcaatcaaggaagattaagaaataaaatgcatccaaattacaaaggaagaagtaacattatctctgtttgcagatgatataattttatatgtagaaacccctaaagattccacaaaaacctgtcagaactaataattgaattcagcaaagtagcagtctacaaagttaacacacaaaattcagtctcatttctataccctaacaatgaacaatctaaaaaggaaattacaaaactattctattggtaatagcatcaaaaagaataaaatactcagggattaaccaaagaagtgaaagtctggacaatgagaagtgcaaaacattgctgaaagaaattaaaaacataagtaaatggaaatacatcctctattcatggattggaagacaatattgttaaaatgtcagtactacacgatgtgatctacagattcaatgcaatctctgccaaaatcctaatgacttttttttcataaatggaaaaatccatcctgaaattcatatggaatgtcaaggaaccctgaatagtcaaaacaatcttgaaaaagaagtacaaagctggaagactcacatttcctgatttttaaattactacaaagctacaatcatcaaaacagtatggtattggcataaagacgcatagaccaatggagtagagagcccagaaataaaccctcacatacatggtcaataattttcagtaagggtgccaacaccaattaaggggaaaaggacagtttgttttttttgtttgtttgtttgttttgttttttttgtttttttgtttttttttgtttttttagatggagtctctctctgtcgcccaggctgaagtgcagtggcgatttctactcactgcaagctctgtcccccaggttcatgccattctcctgccttagcctcccgagtagctgggactacaggcgcccgccaccacgcccggctaatttttttgtatttttagtagagatggggtttcaccgtgtttgccagatggtctggatctcctgacctcgtgatccacccgccttggcctcccaaagtgctgggattacaggcatgagccaccgtgcctggccaggacagtcttttcagcaaatgatgctgagaatagtggaaatccacaggcaaaaaaatgaaattggattactactttacaccatatacaaaaattaagttgaaatggattaaagctcaaaagtaagacctaaaactgcaaaacccttaggggaaaactgagggcacaaacttcacatcgtatgtggcaataatttcttggatatgacaccaaaggcacaggcaacaaaagaagaaagacaaattggacttgaaagatttgtatatcaaaaaactgaacagtaaaaaggcagctcacaagatggagaaatatttgcaaatcatgtatctgaaaagggattaatacatagaatgtatagagatttcccaaaatgcaacaagaaaaaaacagatttttatttttttaagagggagggtctcactctgttgcctaggctggagtgcagtggtgcaatcatagctcactgcagtctcgacctcctaggcttaagggatccttctgcctcagccttccaagtagttgggactataggtgtgcagcagcgtgcctgctattttttttttttattttttgtagagacagggtcttactatgttgctcaggctggtcttgaactcctggtttcaagtgatcctcccaccttcacctcccaaagtgctgggagtataggcatgagtcattgcacccggcaaaaaagttgattcaaaattggcaaaacaggagttggtgaggatgtggagaaattggaacccctgtgtactgttggtgagaatgtaaaatggtggggctgctgtggaaaacagtatggtggatcttcaaaaaattaaaaatagaattactatatgatccagcaatttcacttttgggtatatacccagaaaagtttaaaggaagaccttgaagagatgtttgtacacctgtgttcataacatcattattcacaatagctaaaacgtggaagcaacctgagtgtccatatccatagaaaggagtattactcagccttgaaaaggaagaaaattctgacatacgctctgacatagatgaaccttgaggacattatgctaaataagccagtcacaaaaggacagatactttagccaggcactatggagtgtgcctgtagttccttctacttaggaggctgagatgggaggattgcatgagcccagaagtttaaggctgcagtgagctataattgcaccactgcactccagcttgggcaacagagcaagaccctgtgacagagtgagactccatctcaaaaaaaaaaaaaaaaaaatccttgaaaggacaaatactctgtgattccacttatatgagattccctaaaggagtcaatatcatagggccagaaagtagaatggtatttgttggtggctaggaatagagggaaatggggagttattgtttaatgggtacagagattgttttacaagatgaagatttctggagatggatggtggtgaaggttgcataacatgaatgtatttaataccactgaactgtacacttaaaaatagttaagatggaggatacctttgttgaaagaattgtgaatagcatgattcatttctagcagaggctaagtttaggacagcagcttccattgagaagtctttctgtgtcatgaatagcattttaatgacctcttggctcacataagcaaacaacagggatgtatctgctatgaaaatccatgaagcaggggtctagatgagattatatgatgatgtcttgcaatgtgtaattcattttgctagtagaagaattctttgtagaagttggcagattgaagtgtttttcaggggagtaaatcctccaaacaaaaacaatccaaaatatagtcagttcaagtcctgattttagttctactttgacctctgattataaacaatttcatgtatgttcttactgcttctggttatgccacccagggagtcgtgcaatatgcataacacaatggtcaacctcatatatttgtgattgcaacaataactttgaaggttatgactcatgaagacacagaagctctaaacgctggctttgccaatttattttattttatttttgaaacagggtctcactcagtcgcccatgctggagtgccatggcaggatctcggctcactgcaacatccgcctcccaggttcaagtgattctcctgcctcagcctcccgagtagctgggattacaggcgcccgccccaccactgcacctggctaatttttgtatttttagtagagacggggtttcaacattttggtctcgaactcccgacctcaggtgatccgcccgcctcgtcctcccaaagtgctgggattacaggcatgagccaccatgcccggccagctttgccaatttaaacaaatcaggccctgccctgccctgccctgccctcttctgtttccttccttccctttttttttttcttttgatgggccctgccctctttccttccttccttttttttttttttttttgatggagtttcgctcttgttgcccaggctggagtgccgtggcgcaatctcagctcaccgcaacctccgcctcccaggttcaagcgattctcctgcctcagcctccctagtagctgggattataggcacgtgccaccatgcctggctaattttgttatttttagtagagacagggtttctccatgttggttaggctgggcttgaactcccgacctcaggtgatccaactgcctcagcctcccaaagtgctgggattacaggcatgagccaccgcatacggccggtttctatttcataatcaaataaatgtcccttcttccaccacaatgattaaactatgtatttggttccaggaggtattttctttgtcagttattgtgctgagcaatttaatcttgaatttagaaactaatcttcttatgaagaacacaggaagatgacgccaggtctaggacttggaagtctgcattatggaaggatatggaaatgtgacatttgatcacgggaggttagagagaatgttagaggttcagtctagtaaataatggaccagatacactatgtgaatgaaatattgtgtacctcatctatttgctcatcaaacgcttagcaaaaaccgcatgtgtgaaatgtgtcagagtcaaaatggagtcattaatgttaaaaccctgacgaacagagccagggaaggccatgaagagaggagtctcacacttgtatgttttataacaaaaaagactctacaaaacccacaaccttgcacaaaggccatcacaacctttctaaaagaatatttctccaaggacatctgcccagccactgcttgaccagcttcagactagcatcaccctgtttgtgatctttgtagccaaggataattatttcagaacaattgtgtactactaatttttccctttaaaacctttgtctttctttacttccctgaatacacaaatcatttactgtgctatgtgtaattcccatcgcaatgctttattcccaaataaagatctttccttgttaaaaaaccaacaaaaaaaatccatcaatttttcagagagtgccctaaacacaattttatatgcctcactggttgttaggttattcctgcacttgactttatcattgtttactactagtaaaaagcagcattgccaaataatccctgattttcccctaaaatgatgttaagctttttgaaaagttcaggttaaacttactgttgttagattaatgtatttgttgcttccctttatctggaatgtgtcattagcttttttattttaaccccctttaattcttaattccatgacttaaggtttgagagctaaacactgggacttctggataacacactgatagtttgcataattataatcggcattgtacatagaaaggatatggctaccttttgttaaatctgcactttctaaatatcaaaaaagggaaatgaagtataaatttttgtataatctgtttgaaacattttatttgcttaatattagggctttgcccctttcctgtaagtctcttgggatcctgtgtagaagctgttctcattaaacaccagttaagtccattctctggtactagctactaattcagttttatattctacttcacaatttaaataaactgaaatatttctttttttttcttttttcttttcttttttttgagacggagtcttgctgtgtcgcccaggctggagtgcagtggcgtgatctcggctcactgcaagctccgcctcccgagttcacgccgttctcctgcctcagcctccggagtagctgggaccacaggcgcccgccaccatgccaggctaattttttttgtatttttagtagagacggggtttcaccttattagccagggtggtctcgatctcctgaccttgtgatccgcccgcctcggcctcccaaagtgctgggattaccggcgtgagccaccatgcccagccataaaaggaaatattttttaaaaaaagtagttaagatggcaagttttatgttatatatatacacgtatatatatatatgtatatacgtgtatatatgtgtatatatgtgtgtgcgtgtgtgtgtatatatatatatatatatatatatatatattttttttttttttttttttttttttttttttttttttgaggcagagtctcgctcgttcgcccaggctggagtgcagtggtgcgatctcagctcactgcaagctccgcctcccgggttcacgccaatcttcctgcctcagcttcccgagtatctgggactacaggcgcccgccaccacccctggctaattttttgtatttttagtagagacggggtttcaccgtgttagccaggatggtcttgatctcttgacctcgtgatccgcccacctcggcctcccaaagtgctgggattacaggcatgagccactgtgctcggccttatgttatatatatttgccacaataaaaagattgaaaaaaatgcagttaatatttaaggagaaactgatattgaatttctttttttcagtattttaattaaaatactactgcatttaccttttaaagttaaaagtcacatttctatgcgtttcattcttatcttagtgatttataggaattctctctcttttttttttttttttttttttttttaaagacagagtctcactctgtcgcccaggctggagtgcagtggtgcgatcttggtgtactgcaacctctgcctctaggtttcaggcaaattctcctgcctcagtctcccgagtagctgggattacaggtgctcgccaccacgttgggctaaattttgtatttttagtagagatgaggtttcaccatgttggccaggctggtctcaaactcctgacctcaggtgatccacccgcctcgacctcctaaagtgctaggattacaggcgtgagccaccgtgcccagccaggaattaaagttttgctgcaaatgttttctttcagatgatcacctgctccccttcacctggtcagagccatgctgttaaactaaaagtcagatattgttatttctctctctgctcaaaacccatcttattcagaacaaaagccaaaatctttataattactcccagctcctccctgatacttccagctcttctccatacccttctgctccctaccctccatttctcatcatcctcttcccgccccctcctgtgggagccacccaggcatcttgactctctcagctgcacctggtacactgttattgttgagtgaattaatgagtaaatgtcaggcaaacagtaaccagaggaatgctgatattttggaacaggtaaaagttggctttgatgcaaacagcattttattaaagtgtattagacaggattctccagagaaacaggactaataagatatatatagatctgtaagagggggagattggtgatgacacttggtgcacgtgattatggaggctgagacgtctcactatataccttctgcaagctggagaagaaggaaagttggtggtgaaattcagtctgaatttgaaggcctgggaaccagggtaactgatgctgtaactcccaatccaagacaaagcctgagaacctgggatgggagatggctggtgtgaatctcggagcctgagggtctgagaatcaggaactctagtgtcccagggcaggagagactggatgtcccagttcaaaaagagagtatttacccttccttatcctttttgttctgcccgggtggactctcagtggactcggtaatgcccatccatgttactgaggcaggtcttctttactcagcctactgattcaaatgctaacctcttcctgaaacaccctgacacagccagaaaaaatgttttaccagctatctgggcatcccttggcccagtcaagttgacataaaattaatcattacataaagtttgtctcaaatttcaagaatcagtatcatatagtctctttgacaacagtgcatttaaaccagacactgatgaggaaaacatagttgatagcatataatacatatcacaattgtcttttttcacttaatattctggacatgtttatctattggcatgaatagagccatgacactttcaaaatgatacacattaactaaggtatgccattgttttagcttgtcccctgttggacatgtttttcaggttttaattattacaaatattatgaaaatatacccttcctccctggaatccttaatagcgtcacccgattttaattttgtccacatctctaatcagcatcttacgtatctattatgtctccttcacaagaatggtagtttcatgtgggcaaggactttgttttgtttcctgctatatctttagtgttggagacagtgccttttgtgcagtaggtgttcagtaagtatttgctaaacaaatgaatgtttccatgcatgtctttgcacgtgcttcgtttacatgtgctgatgtttaacaaagattctgaggaaaagttggattgtaggagacgtgtgttttaagttttggttagtttttagtttttatttgatttattttttttgagatggaatgtggctctgttgcccaggctggagtgcagtggcaccatcttggctcactgcaacctccgcctcctgggtttaagtgattctgctaccttagcctctcgagtagctgggattacagggacctgccaccacacccagttaatttttgtatttttagtagagacagggtttcaccatgttggccaggctggtcttgaactcctgacctcaagtgatccgcccgccttggtctcccaaagtgctgggattacaggcgtgagccactgtgcctaggctgtttattttttttttgaaacagggtctcgctttgttgcctaggctggagtgcagtggcataatcttggctcactgcaacctccacttcctgactcaagggatcctccagccccagcctgctgagtagctgggaccacaggcatgagcccacacccggctcatttctatattttttatagagatggggtttcaccatgttgcccaggctggtctcgaacttctgagcacaaagtgatccagccgccttggcctcccaaagtgctgggattacaggtgtgaaccaccatgcctggctgttttaagttttaattagctgatttcagctactcaggaggttgaggtgggaggattgcttgaacttaggaggttgaggttacagtgagctatgatcacagcactgtactctagcctgggtgacagagagagaccttgcctcaaaaaaatgatactgcaaactacccttcagaataagtggtcatacccatttaccataaatgtatctctcctcataaatattctgaaaatatttgctctttttgccaatttgatgggtgaaaaaatggtttgtcattgttttaatttgcatctgcctggtaactgagtttgagtgtatattcatttgtttattgactatttgcattttttcctgtgacttaatgtgaaaaacttgtctagtacacaagggtttcttggctttttggaaatagtatactaacttttactattcttttcaggtcactcagccaaaggagctcagaagtagagtatattaacaaatacagacagctcgaagcacaagagcttgatgtgtgtcgcagtgtccaaccaaccagtgggccaggtaaacaggtctctttaaatattttagataggatgcatgagtggttcacatgctaaaatattaggttcatagtgcatgcctgtaattccagctactcaggaggctgaggtgggaggatcacttaaggccaggaatttaacactagcctgggcaacatggtgacactctgtctctacaaaaaataaaaaaactagctggatgtggtggtgtacatctgtaatcccagctactcgggaggctgaggtgagagggtcacttgaggctaggagttcaggttcatcctgggcaacatacggagaccctctctttaaaaaaaaaaaaaaaaaaaaaaaaaaaaaaaaatatatatatatatatatatatatatatatatatatataattattaggccaggcgcagtggctcatgcctgtaatcccagcactttgggaggccgaggcaggtggatcacgaggtcaggagattgagaccatcctgaccaacagggtaaaaccccgtctctactaaaaatacaaaaattagctgggtgtggtggcgtgtgcctgtaatctcagctacatgggaggctgaggcaggagaatcacttgaacctgggaggcagagattacagtgagccaagatcgtgccactgcattccagcctggcaacagagtgagactccgtctcaaaaaaaagaaaaaattattagaagcctttaagaaatatagtggcgaatacaaaaattagccgagcatggtggtgcatgcctgtagtcccagctactggagaggctgaggcaagagaatcgcttgaactgggaggcagaggttgcagtgagctgagatcatcctaaatagtctgttcttcggaagactaataatggtttcttaccttgctattaattaaaactacttttttttttttacaataaagatattaaaatgacattttaaacaatgcagaaatgtataaaataaaaaagtaaaaggtccttcttaaattcccagttcccaagagtacaactgttcagagttcaccgttagttactttctgtgagtatggagtttttttctgagcaaattatcttactagcaccaggccctattcatatgctagaagttatcttttgattttttttgctttatgagaggtcatctgtcatagatttctgctagttcagttgagaagctctgcctcctgtcctgccatcctgcgtattagtgtgctcagagtcgggcacaaatgtgggttcaagtaacactttcttttttagccttttaaaaagtatgaaatacagtcaatacataatagtagattaatccttatcattcttgggattgatttaggcttcttgactataccaattagtaccttttaattagtctaggaaaattctgagccatcatctatggcccactctttcatttagttttgtgtttttcatttttttggtcagtgtgctctgttctggttaatttctgctagatctatcaccttaaggtaaaagcagcctttggttgtttgcctccctttctgtgttcttgcctcatcacaggctttggcctgatgtctccttgctatttcatcagccctttggtgcttttaaggagaggtttgtgtatttcatctaacatctttagttgatctcaggaaggagatttgtctgaacaacccagtgtattaacagaagtgagcattcacagtgtatgttatctctggtccaatttctacttatgctaagaaaagtacaaagttgtacgtataagaatgtttattgaattgttacttaatctatgggaagtcttaagaatctcctatatgccagtgaacagaggattggtgactttggtcttttgtacaaaggaagagtactgtgcagctttggaggtaggaagtagccgtatgtgttattgtggaaagagagccatcatctaatacttctgtttggaaagcacattagttagtttatagatgactctgtgtgatgtgatccttcttgtcacactcacgtactggcccaggggcacaggcagcagcccggcacaccctgcgtgctgggcctgtagcgtgccggatggattaccactctttaggactagctagattacaaatgaatgcctgaaactcgaagtgtctgttctcatacttttaagttcatatgtgaaactctctttgctttctttatgcatggtatcataatatatttggggcttttctctgggcagtcggatcaactatggctttggctatttatggaggtttgggctacttagccactgacatttatcaaggtgtgttccagggactgtatgagacagcgagaatatgacaagtaaaaaagactttaactctgatcatctctgatcattgtagagatgatcatttagtcatccagttacacaaataaatgctttttggaaataagttatctgaaagccagctctatgggggtgtaaaacaaggatttgacttgggctgtggtgtcaggaaagtaacagttgagctttgatctgaagggtgagtggaccttactgaggcagtgtgggggtgcagggagggaaatgtgtgcagaggccttgtgctgggaggaagcctggtattccagccctgaaagaggggccagtgctgctagggagtagacagtgggtgtgggagggctgggcagggtcagctggaggctaatagcctcctaaagaggtccatgttctaatccccaggacctgtgaatatatcaccttcatggtaaaggggtctttgcagatgcaaattaaggatcttgagatgggaagattttccaggtgggcctaatgtcatcacagggtttttcctagagggaagcaggaagatcagtcagtagtagatgtgacaacagaagtcataggttggagtgatacaaggaagaggccatgagccaatgcaggcagcttctccatggctgataaggcaagggaatagattcttctttacagagcctccggaaggatccagcagccatgccaacaccttgtccttctcatctttgaacctctgcttccagaactgtaagagaataaatgcatgttttaagccactaagtttgaggtaaaatgtgacagcagcagtaaaaaactaacacacttgtattggatgaggttggatgagataggcaagactagtaatagggcctgtgggctgtaacgaagagttttggtcttaatactcagagcagtgggaaggtatgaaagtttccatgcttttcttgggatgactgtgaagggaggaagagggtgtcatgtgtttagatttgtgttttacaaaaagtgctttggtcatatttttgagagttgattggagggggccagagtggacctgaggagaattggaggcattgtcctagtccaggtgagacttgatggtgtctttgacagaggatggcagtggaggaggagagccagttgaaggacaaaccggacaggaattggtgatgccttggacacagggtgagggaggaggccacaggaggcagagaggtgctgtccacttctttttccttgagatgaggtcttgctatgttgcccaggtaggccttgaactcctagactcaagtgatcctccagcctcagcttcctgaatagctgggactgtaaacatgtcaccgtcatgtctgctaaatgttttgaagtgttgaagtgcctctggagcactgaagaagtaaggtcaggttatcgtgtgtgtgtgtgtgtgtgtgtgtgtatgtatacatacacacacacacacacagacacaaagctatttctatgtctatttctattaaaaccatgagattacactgatgcctctaattccagtccagtgccacaggtttcagcatgaacattttgttatatccagttataaaataatttgattcaaaacacttttgattttggcctgatacaggtgttatttcacttataagtattaaaaattatttctaaatagaaatccaaggacacccattcagtgaatttctatcgattacagtagaatcattttacatggttaaagattaatcattttttaaaaactgagatttatttgcattgataaatgaaatctttccttacagtgtgagcctagttctaggttgtcgactcctgaagggttctgttgctttcacacaacaatttgaatttgtcctgggatacagtctttagattgtagttaaattccacagtgctgcctccttttaaatgtggtgatatatttagtggctgttttcatcctccttttagcttttcttctggttttaagagaatggcctatgtggaatgtctaataaccgaaagagaaacattattcttccttcaagttaattttgtattcagaatactagtccatatttggagaaagtcatatataattatctatttggaagatttaattttatggttacatcagtaatccagtaattaaaattattttctgtaatatatagtgtgtagatttgaagataagtcttaagttcaccatgtgaactgacatacttaccagttaaaattccttacatgctgtttagaacctctaggtgctgaactttttggttagatttcatatttggttgatggtgatatagtgatatgtcttagtgaagagaactagcaatttttatggcttccagttttccccagttcatgtaaaacattgtgttgttaatcatgtaggataaagagacagcaagaaaataagaatagtcaattttaaggttgagctggtcctcatgccgtttttggatttttgctttgttgtatgtagtttgttgatttgccttaaattatccgtgatggatttccttcttattctgttgctgatgcaaaggtgcgagagccacacagctgggaacatttctgctgtttggtttcctgtctgccctttggcagtgtacgcggaggcaggacttgatttgtgctgggtctgcttcagccagtgacctaaaaatgtcagcttgtgttttgcgttacatggagaaggggctatggtatagacagtaccgttaggacttctggcattttttcttgtaaaatttctgtctttaagtagcagtcttcaaaatgcatgtaatcaagtaatgtaagccaatattgtctaagtaacagggcttgtttagcggcatgtgagccagggcttgaagtcttttagcaaaacgaacgtggctgcagcctttttcgtctttctaaaagaatctttgtcaccttctttcccctttgagtagctcttcctcagcttcttactcccaccctgttcctcactagaatacttgcctctccctttgtctgcatgctgtgtctgggctcagggccttctttctctcagtccagttcacaagggccatggggattctcttccccttctttcattatgttcaagaaggcctaggtatattaactgggaaaacaagaaggcatcagtaattaccatagcactgagaagaggaatggaaggaaagtgagacgtgataatggaaagaaaatccctgttttagtaaacttggcaatcactagttaggctgattagaagattaaaaagccataggtcaggcgtggtggctcatgcctgtaatctcagcaatttgagaggccgagatcaggagttcaagaccagcctgaccaacatggtgaaaccccatctctactaaaaatacaaaaattagccgggtgtggtggtgggcacctgtaatcccagctactcaggaggctgagggaggagaatcgcttgaacccaggaggcagaggttgcagtgagccgagatcgcgccactgcactccagcctgggggacagagcaagactctgtccagaaaaagaaaaaagaaaaagaaaaaaggaaaaaaaaaaaagccatatcggcaggacagctttcctgagttaggggtcactaatattttaggaagaacatactcacaaagaagctatttttgctttgagaaagtatgacagatctggttcctctgtttatataattgagaacagggaccacgtaactttgattcaaatgtgggaaaatagccacattttaattacatgttattagaccagttaggaaaatgggaatatatgtagggaaaagatgtaggaaaacaagagagaagcctggttgtgtgttttattaggaaaggccgagggtgacacagcaggagatgctggtcagaaacaaggggctgataggaagggaaggtgagtcgtggggtaagggaatgagtgcggtgctaaatttggctaagagtttattttggaagtaaaacttatttcccagcaaaagtttgtcttccgtgagttttgatgatttgccagtttgtcaagtgatgaccagaggtttagaatttgtagtgcagccagagagcagggcatgtttttacaagagggcagagaagtgtgcctggtcagagctctgtgtcatgtatcctgagcagaggcaagctgcctgctttcctgatacctgtatttcataaattgtttgatttatttattgctatcactgatgtattttagtagcagggaatgcacacttaaattgatgcattctgttgaaatttcaaggaaaagttttctctttaactgttttggtaccactgaatcagcaatgagtgcgtgttttacaggcctgttttagaaggcagtgctgagcttgcaatattggtggctgtgatggagggatagaatgttctcagtttgcttttatacaagattaatagtgggctgctaagggaagtttcttaagaaattaaactttttattttagattcgggggtgcatgttcaggtttgttacaagagtatattgggtgatgctgaggtttgggcttccactgatcccatcacctgtatagtgaacacagtacccagtaggaagtttttcagcccttgcccctccctccctcttcttcttggagtccctagtgtctgttattcccatctttatgttcgtgtgtacccaaggtttagctcccagttgtgagaacatttaatatttggttttctgtttctgtgttaatttgcttagatggcctccagctacatccatgttgcttgctgcaaaggacatgatttcattcttttttatggctgcatattattccatggtgtatatgtaccatgttttctttatccaatccaccattgatggatacctatgttcgttccatgtctttggtattgccctgatggcagttttagcctgtagaaaatgtatttttgtatttgagtgtgtgtgtgtgtgtgtgtgtgtgtgtatgctgtatctatagattagaacattgagttatctttttccagataagaaatggcattgtatttgtttgttttgccttaatccaggtccaaggccatctttggctaaattaagcagtgtgacatgcatcccagggacaacttataaatatcctgatttgcctataagtcgatacaaggaagaggtaaaattgttttgttatactgtaattttgctgtttgaatacatgtctgaggcccaatacttttggtttctaatttgaaagttaccagttgccaggtgaacacttctgtggtgtacaaggttctgtggtggataagaggagggtgtgctcaggccaacctgcagatgattttgtgtagtaaccatatcgatggcttttcttttgatctgtgctttaatttctttagtcttcgcctgagtacatcttctaacatttagtttatctagtctttccttcctcaaaatatctgcaagtaaacacttagtcttccccaggagagcttcttgtttaaataaactcactgctaaatgtttttatgaagcaaatgacataccctagcatttccactgggttttctttacagcgttggccctttctctgcctgttgattaatgtaatcaatcattgacataccattgtattaacaatgccaggcagatgtaacagtaggacgattaagttcctaattacttgcgtgttattaagcatcgttaagagtaagcgtatcggaacctttattaactggaagaaggagttacagataaaactagaaatgtttcaaatttaatttttactttgctttagagtaaatcatgcaactaaaaattagaggccagtattcaaattaatttgtatttcctgaccatatcaattgttagaaggataagagcttaaataagtttagagtggaggtcggggagttctggaggaggaatttgagtggagttttaaaaatgctgcatataatctgtaagtggaaaagtggaagttacttgtttccaaatatgtctggaggtgggaggatcacttgaggccaggagttccagaccagcctgggcaacatagcaagacctcatctctacaaaacacaccccccaaaattagtggaatatggtggcacgtgcctgtggtcctggcttgggatgctgaggtggcaggatggcttgagcttaggaggtcaaagctgcagtgagccatgattgtgccactgcactccagcctgggtgacagagctagagcctgtgtctaaaaataaataaacagatatttaatagataaaaatatgtctgaagaatttaagatgacattttaaaaccacttgaatgtagtaacagctctttttctcatgttcagtagaattatttgcagattcattacaaaatgttaatagaaacttgggaagagtcatagaaatctaattttacattttcatttttacagaagcagttgagacccaggaagctggagttaacctggcctggtttttccacagctatcactagttactattttttttgttgttgtttttgtttttttgtttgtttgttttgagatggaggcttgctctgtcgccaggctggagtgcagtggcacgatcttggctcactgcaacctctgtctccagggttcaagcaattctcctgcttcaacctcccaagtagctgggactacaggcgcgctaccatgcccagctaatttttgtatttttagtagaagcagggtttcaccatattggccagaatggtctcgatctcttgacctcgtgatccgcccgccttggcctcccagagtgctgggattgcagatgtgagccacctgtgcccagccactaattactgttaaataggtagtagagttgcatttaagtgtggcaaccgtttgtcgcctccttgctctcttgtgttgtgtttagaatggttaattaataactttaagcaatttgggaaattgctggtaatcccagcaatttgggaggctgaggcaggcggatcacttgatgtcaggagttcaagaccagcctggccaacacggtgaaagaaaccctgtctctaccagaaatacaaaaattagctgggtgtggtggtacacgcctgtagtcccagctacttgagaggctgaggcatgagaatcgtttgaactcaggagacagaggttgcagtgagccgagattgcgcccctgcactccaggctgggcaacagagcgagactccatctcaaacaaaacaaaacaaaactttaagatgaaagaaaaataaatcctgaaagacttcttaatataggtgatactttacattgccattttgtgctgattttgaaagaattttttaaatttctaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtgagactgggagggagggagggactaagagagccagctgtctctctattccttaattttattaagtttttttctgtgtaagttgatagtatgtgaccattttctgctgaaaattagttgtgtctcatgcctgtaatcccagcactttgggagaccgaggcaggcggatcacattaggtcgggagtttgagagcagcctggccaacatggtgaaactccgtctctactaaaaatacaaaaattagccggatgtggtggtgcatgcctgtagtcccagctactcgggaggctgtggcaggagaattgcttgaacccgggaggcagaggttgcagtgagccaagcttgcgccactgcactccagcatgggcaacagagtgagactctgtctcaaaacaaaaaacaaacaaacaaacaaaaaaagaaaccagctgcttatagaagagaactgtggcataattttaaaaagcagtgaaacagaatttcttgaaaataaggctgggcatggcggctcacgcctgtaatcccagcactttgggaggctgaggcgggcagatcacttgaggtcagaagtttgagaccagcctggccaacatggtgaaaccccctctctactaaaaatacaaaaattagccaggcatgatggcacatgcctgtgattccagctactcaggaggctggggtatgagaattgcttgaacccgggaggcagaggttgcagtgagctgagatcatgccactgcactccaacttgggtgacaaagtgagactctgtttcgaaaagaaaaaaagaatttcttgaaaataaattgtaatttctttccagttgaataggaaagcagtaagaattctcatgcttatggcttttataattttatctttttaattatatctgtaatctagaagatgtcttgatacacaattgttttaacataaaaatgttatagcagtgtgattagatgagccaacccctgccgccctccccccaaaaaagaagaaaataattgacttgagaatgtcacttttaatttggagcctgtgtatctttcgaaataccttaatttttcattccctttcttacccccattatattaataaaatggacataactttttttttctcttttttcctttcctttttccttctccaattttaggtagggctagagaaaatagcaacagaggacaccaggctaatttatatgacaactggagtcctgcttcagaaaatagttagtgccaagagtttgatggaattcacacatatcatcattgatgaagtaagtgatgtcatctacttgtaaaggtcatatttatctctcttaaaaaaactctcagagtattgtgaaccctgtctttgtgcctgtctcagctttctttattttttccttcccctttactttctggacttttctcagtaaggatggaatgttttttgattttgtttatattttaaacatgagttttttggtggggaatgttgtgtttgaataactttcccaagaactttggtactggttcttaaactcttgtgttttaaaccttatcagtaattctgtttgggaagcttgacttatttctagaggaattagacacatcagcaaataaataggatttgtgagaggttgtgagacaagggtagggtgtttaatagagtctgaaatcaaaccatttgggcaacgggctcatgcctgtaatcccgatactctgggaggccaaggtgggtggatcacttgaggtcaggagttcgagaccaacctggccaacatggtgaaacccatctctactaaaaatacaaaaaaaaaaaaaaaaaaaaaaaaaagattagctgggtgcggtggcacacacctatagtcccagctacttgagaggctgaggtgggagaataacttgaacctgggagatggaggttgcagtgagctgagtttgtgccactgcccttcagcctgggcaacagagtgagactgcgttggaaaacaacaataacaaccaaaaggataaacccatttgggcaactgtttagggtagtgtctctgcactctattttgatgcatgggataacgaataatacaacatatactccaggcaaagctgagtcagtgcgtttgtgatcttatgtacaggcacttggttttaaattattgtagggcatttggtgggagagtaggagagggtgaaaatgatctactgtttcttacaaaatagggtgatatataatacggttcagaatttttctttatgacttatggtagttttgaatatctttatagtaggtagagacaaattcagatttaatagataatatgccaaaagatggcattatgaaggttgtaatagttattcattgggctttttagtataattgagcccactttacataaaaggaaactaaagtttaaggaagttcagtgctcaggccacaagtaattagtgatgttgctgggttcatccctgggtagtttactctagaggctgtggtgctggtgcctacatttattttctgtgtgtctgacatatttctctgcctacgtggcctttgcacacccatacttgagtgacacagataaatccatcaatgctgtgttactgactatatccttttctcaagctctgccttaatagctgagcaaaagttagctcctctcttcgagagcttgccctactggggagcggtaaccaacagaagaccatcgcgccatcacggcagcttcctgctctgcctctgtctggtgcggtgtcagcaccttgtagatgccccagggattatttgcttcataaatgaatggactggattcaactacctgaagttttaggtttacatatagtatcgtttgcattatctgggattatttgaatttcaaaacaaatacaagaacaaaagttgaagatagccagccagtttaaaatggaataatgttttaaactttccagctcttaaggataaagtagcttgggccgggcacggtggctcacacctgtaatcccagcactttgggaggccgaggtgggcggatcacgaggatttgtgagatcaggagatcgagaccatcctggctaacatggtgaaaccccatctctactaaaaatacaaaaaattagccgggcgtggtggcgggcgcctgtagtcccagctactcaggaggctgaggcaggagaatggcgtgaacccgggaggcagaggttgcagtgagctgagattgcgccactgcactccagcctgggcgacagagtgagactctgtctcaaaaaaaaagaataaagtagcttggccgggtgcggtggctcacgcctataatctcagcactttgggaggccgaggtgggcggatcaccaggtcaggagattgagaccatcttggctaacacgatgaaaccccgtctctactaaaaatacaaaaaattagccgggcatggtggcgggcacctgtagtcccagctactcgggaggctgaggccggagaatggcgtgaacccgggaggcggagcttgcagtgagcggagatcgcgtcactgcactccagcctgggctacagaataagactctgtgtaaaaaaaaaaaagcaaaaaaaaaaccccccaaaaaaaactagctttaagcaaatcattcattcaataaactttttttttttttttgagtactgctatggaaaaggtgcctcctaaggggctgaggttataaagatgagtactagggagacccatctgctgatgtgtgtatgtttatgtgttagaaaggctggtgtagggatcctggagccagtgggttgcggggcagagggaagatgatgggtgtgtgaactcagaagagactgccacaagctgaggagagctcactttggggctttttgctgatgatagccttgatttttcttctcaagtaaaagagaggatgtttgtgctgaggaaatgttctgaagtcaagtgacagcatgagatttatgatgatgttaaataccttttagctactgatttttgtttttcttttctctatgctacttctctagacatctccttcagtgggaagttcagaagatagtagggcctggaatagaattacttacagaataaatccttacacctcttacactgaggaaaggagaactccctctttgaaacttagtaattatctctccacttcggctgagaaatgtcccagaatagaatcttaccgtccccttgtacattgatgtttcctaagttctagagtaactggcttctttagaacagtagcaggctgcctagcccttgggtgctagctggttctggggtggggcggggtgggggggctgtgggtcctggggtggctctgactgtgaggtctctgtctgaggagggctgcaaggtctgtctgaggtgctgcctccctgactgctgtccccgagtgtcagtgctactgacctcgggtcctaaccttgctctggtttacctgtttgtgactgacccagcttttccaggaccagcccttgcccacccttgtgagctgcagttatgcacatcatggaatgtgtcctgtaggggtcacatggctcccggtcagtgttagactggcacatcttcttccctgtgcttgcttgctcagatgacagtgtacctgcaggcctggcaggggttgtggcaaggaggggccatgggaggctggcccagtggttctctgtgcttgaggtaggtggagaggtttctggttgtcacagtgaccttgggcacagttggcagtaaatgagcaggggcgagggtgcagaacattactctgccgtctctcagggggccctaaggagaaacactgggggccgtgactgagtgggtggtctgtggtctgttggccgatgctctttgcttcctcttaaccaggagtgatactagccccctgaggaactgcatttagcagagagaactggtttagtccccagtcccccagtggtgcctttctgtcagcagtgtcatgtgtgttgcctgatgccatgtggggggtgcccccttttttattttgtaggtacacgaacgaacagaagaaatggatttcctgctattggtagtccgcaaactcttaagaacaaattcacgttttgtgaaggtaaatttgatttcatgagtaacagacatatttaggattaagattcattgtttagttttgtttctctctatagtctgttggtgtctatagagcattctgggaccccggacagatactaaaatctgaggatcctcaagtgccttatatgaaatggcatagtaaagtatttgcatgtagcctatgcacatcttcccatatgctctaagtcacctctaggttatctacaatactgaatataatgtaaatgccatgtaaatagttgctatactctattttttaaatttgtatttttattttttctgaatatttttgattttcagttggttgaatctgcaaatgcagaatctggatacagagggctgactgtattttttttttttgagacggagtctagctctgtcgcccaggctggagtgcagtggcgtgatctcggctcactgcaagctccgcctcctgggttcatgccattctcctgcctcagcctcccaagtagctgggactacaggcacccaccaccaagcccagctaattttttgtatttttagtagaggcggggtttcatcgtgttagccaggatggtcttgatctcctgacctcgtgatccgcccgccttggcctcccaaattgctgggattacaggtgtgagccaccgcgcctggcccagggctgtttgtttgtttgtttacttatttatttattttgagatggagtctcactctgttgcccagggtggagtgcagtggtgcgatctcagctcactgccacctccgcctcccaggttcaagcaattctcatgcctcagcctcttgagtagctgggactacaggcacccaccaccatgccaggctaattttttttttgtagtttttggtatagatggggttttgcaccaggctggtcttgaactcctgacctcaactgatttgcttgctttggtcttccaaagggctgtgattacagatgtgagccactgcacttggccgggctgactgtattttaacagaaacatttgaaactgatgacgcttaaaattcatgatcatgtgtagtacaccagatcttgccaggaagccaactaaggggcattcttttatgaacagagtacggatactttttggttattatgttgccttaaactctcatattttctccaggctgcagaaaatggtctagttgactataatgacatgctgggttttgagctttgcttttggttgaataagtaccacagtttaaaggtatgtgaatgaagctgggtggtacagtggctcacgcctgtaatcccagcagtttggggggcaaaggtgggcagattgcttgagcccaaggagatcaagaccagcctgggcaacatggtgaaaccccatctctacaaaaaatacaaaaactagctggacatagtggtgtgtgtctgtggtcccagctacttgggaggctgacggaggattgcttgagcctgggaggtccaggctgcagtgaactgtgattgcgccactgcactccagcctgggtaacagatgagaccctgtctcaagaattagccgggcgtggtggcgggcgcctgtaatcccagctacttgggaggctgaggcaggagaattgcttgaagccgggaagcggaggttgcagtgagccgagattgtgccactgcactccagcctgggcaacagagagagactgcatttaaaaaaaaaaacaaaaacaaaacaaaaagtaagtgaatgaatctgcagtccctgtgttcgaaatagcaccaaagtgcattgaaatttgagaacagagtatgtactagtatttgagagacgtaagtagagttaactgaaagttgatgggaatgataaatatcatttacttcttatttgaacaaaaaggaagaaggtgtgaactaggccaaaatggcgaagggtttagaataattgtgcagtctaaataagtctactcataggtcgaccttaacccagctgtgctaagcagaggtctgtgggaaacagcttgataaaaggccgcatggttgggttattcagttattctatgatggggctgctttggaaagcagttgctttctaaaccataaagcattttgtcttcaagtgtttatttgttgaggaaaacatttctctttctctttcccatgtccccaggtggggaagcttctgccttaggatgttcatattttcactgggtgggtgctgaatgaatggaactcgacacttgcaatcagttgtcttattgcttgaggtgactatgaaatgaatgagagaatttggctatttcagtcctttttggaatcttaaccaagctgccattgaagattattcacattgagacctttcttgaatgtcatttaagactcttcttttttactcaagtcagaataatgagttggttacacattttttagttttcaatggtaaaaagagttagacaagtgttagtggattaacaaaaccctacactgatggacatgttggtaaggaatttggtacttataagttgtaagatatggttggtcagtttcactgtgttcatgatttattaacaaatacgtgaagcagcatattttctcgatatagaaacttatatggtacatgtagttgggccaagaaattagacaccatattctaggtggttttgtaagaggtttttaaaaaactctcaaaaaatctgtatcagcttttaaagagagtgccgctgtcaagaggacctgggtgtggggcacgggcacatgggctttaaggcctcccctttcctctccccccaacctttaggtccctgtggttcccccgacctggcttcctctcactgcctcctctataccatcctccagccactgaccttgttgtcacctcttgctgactggactcagctcaggcccactccagacaggcagttgtcttgggtgtctgctgacttgcctgtttggagaagaggcagagggctgccggggagggtggatgagggaggctggtggccaggctgagtcctgcttgctccctgcattccaggcttggcctcttgtttgcaggctgcactctgtgtcctgcagttcactggcctcgtcgttccttaaaacccagtttagagatcatttatggtgactggggtgtgtcccttaggagcctctcttccactccaagtggcttctgagagcattctttttaacttcagacatctcaaaatgagttttagtctgtacagtttttaccatttgtatctcattccaaaggggaaaatacagatgttttctttactcaataactgcaacaacaatgcttatatgaaatgtttactttttggctgggtgtggtggctcatgcctgtaatcccagcactttgggaggccgaggtgggcagatcgcctgagctcacaagtgtgagactggcctgggcaacatggcgaaaccctgcctctacaaaaaacagtcacaaaaattagccaggtgtggtggtgcacacatgtagtcctacctacctcagaggctgaggtgagaggatcactgaagcccaggaggctgaggttgcagtgagctgacatcacaccactgcactccagcctgggtggtagagccagaacttgtctcaaaaataaaaaagtttactttttggctaggatttcctcttagatacctctacttgcgatgtacagtaggtggtgagcagccagccggactgctgtgcccactccccacgtagcattatggagactgctgagctgggagaccctccataatcagccactttctcctggcacgtctcgggctgtatgcactgctcctgtcattcatggctgagtttcttaaggatatcatttcatatttgctttttgacaaaactggaagctgcagtcagtcatcttgccccagtctggggttgttcctctgctcctgcaccactgtcgtcctgggacttctccagtttcttgagttggagctagagttttctagatcccgttttctttgctggcttactctgtcatttctctggaacacatcatagagtaacttattctttttaatttattttttatttttgtttttagaaacaggatcttgctctgttgcccaggctagagtgcagtggtgtgatcatagatcactgcagcctcgacctccttggctccagtgatcctcccacctcagcctcttgagtagctgggactacaagagggcaccatcatgcccagctatttttaaattttttgtaatgatggggtcttgctatgttgcccaggctggttttaaactcttggcccaagattacaggcatgagccacggcacctggccttactctttttttaaaatttatttttaattaattaatttatttttttgtagagacagtggtctcatgttgttgctcaggctggtcttgtactcctgggctcaagtggtcctcctgcctcagcctcccaaagtgctgggattataggtgtgagccacagtatctttgtttacctgggccttattcttttttaaaattagtctcctgatgcaaagttttctttcagaaaaatggttttaatttacccttattggagatgaaatttatcatttgaaaaggtactcgaagagaaatagtaaaagttggtatctctgaacattgtttaaactacaataattacactagagattaaatcagggtggtctgtttaaagtctcaaaagttgttagataaggagtgaagcagaagaaaagcctgcagttttagaagtatttaatttgtgatgattctcattgttttatttgaatgttttctcttactctgtaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaaggtatgttagaatgtgctgtttcttttatagtgagcgtactcttgtattggatcaaacctgcattcatcacctatgattgtaaggccctgcgagaaaattattattttaaaattgatgcatactaagtgtacatatttatggagtatagtgtggtattttgatacataggtataatgtgtcatgatcaagtcaaggtaattagcaaatccatcatctccaacatttatcattgttaattatctttaacatttatctttgtggtgggaacatttaaaatcctctcttctagctatttgaaaataaacgataagtttttgtcaactgtagtcaccccacggtgctctagaacacgaaaactgggcgtagtggtgggggtctgtagttccagccatagtgggaccctcatctctctttaaaaaggacactagaagttatttcttatctagctataattttctgtccattaaccaacctcttcctatttcccccccttcccagcctctagtaacttcttttctactttctccttccgtgagatcagccttcttagcgtccaaatttgaatgagaatgtgtggtatttatctttctgtgcctgacttatttcactaacttcactcagccatgttgcccagaatgataggattttattcttttttcatggctgagtagtatttaattgtgtgtatatactatattttctttatccattcatctcttttttttctttttttttttcgagacagagtcttgctctgttgcctaggctggagtgcagtggcgcgatctcagctcactgcaagctctgccttccaggttcacaccattctcctgcctcagcctcccaaatagctaggactacaggcgtccgccaccatgcctggctaattttttgtatttttagtagagacggggtttcactgtggtctcaatcccctgacctcatgatccgcccgcctcagcctcccaaagtgctgggattacaggcatgagccaccgcgcctggcctatccattcatctcttaatgtacacctaggttgattccatatcttggctatggtgaataatgctgcagtaaacgtgagagtggagctatctcttcagcatattgtttttctttcctttggaaatatacccagtagtaggatggctaggccatatggtagttctgtttttagtttttttgaggatcctccatactgttttccataaacgctatactaattgacattcctaccaacagtatacaagagttcccctttctttgcatttttgccagcatttgtcatattttgtcttttatttttacttatttattttagagatagggttttgctctgtcacccaggctggagtgcagtggcactatcatagttcactgaaaccttgaagtcctgggctcaagcggtcctcctgcctcagcctcccaaagtgctgggattacatgtgtgaatcactgcacccagcctttatttgtcttttgataatagctattctggcacatgtgagataatatctcaatatggtttggatttgcatttccgtgacaattggtgatactgagcattttttcctgtattagccagtagtatgccttctgtttagaaaagtcttttcagctcacttatttgcccattaaaaaaattggattgtttgggcctggcgcggtggcttatgtctgtaatcccagcactttgggaggccgaggccggtggatcaccaggtcaggagatcgagaccatcctggctaacacggtgaaaccccgtctctactaaaaataaccaaaaaattagccgggcgtggcggcaggtgcctgtagtcccagctactcgggaagctgaggcaggagaatggcatgaacccgggaggcggagcttgcagtgagccaagattgcaccactgcactccagcctgggtgacagagagagactccatctcaaaaaaaaaaaaaaaaaaaaaaaaaaaaaaattggattgttttttgctgttgagctccttgtatattctgggtattaatcccttgtcagatgaatagtttgcaaatgtttccccccattcactcagttgatttctttctttttttttttttttttgctatgcagaagcttgttagtttgatataatcctatttgtctacttttgcttttgctgtctgtgcttttgaggtcttagccatcaaatctttgtacaaatatatgtcctgaagcattttccctatgttttctgctaatagcttcatagtttcaggatttagtttaagtcttaaatccattttgagttgatttttgtgtatattgagagagaggggtttagttttatttttctgcatctggatatccagtgttcccagcaccatttattgaagagactgttctttctccagtgaatgttcttgatgcctttcttaaaaatcagttggctgtaaatatgttattttatttctgggttctttattctgttccattgatcatctgtgtgtctgtttttatgccaatatcatgctgttttggttaccattgctttgtagtatattttgaagttaggtaatgtgatgcctcttgctttgttcactttgcccaggattgctttggcttgtgagatcttttttggttccatatgaattttaggattttttttttgatttctgtgaagaatgtcattggtattttgattgaaattgtatgaatctgtacatcactttgggtagtatagtcattttaatagtataaattcttccaattcatggcaaggcacagtggctcacacctgtaatctcagcactttgggaggccaaggtgggccgatcacttgagcccaggagtttgagaaagaaagcatagggaaaatgcttcaggacatctatttgtagttaacatttacttagtaacacttaaaaaaacctactaactaaacttcactttatttggtttgactgtattttccataatgtcctttattctgggatcccgtccgggatgctacattaggtttggtcgcgatgtttccttaggctcctcttggctgtggtagtttctcagactttcctcattttttaagactttgacgatttgaagagtactggtctttgactgatgtttttctcatggttaaactgaggttattggttttggggaggaagaccacaggctgaggtgccatttttgtcacatatcaagggtatacactatcaacatgacctttactggttgtcttaagtctgtttaatgttttttttaattaaaaaatttaaattcacacataataattcatggggtacatagtgatgtgatacatacaatgcatggtgatgagctcagtgtaactagcatatctattgtatcaaacatttttttgtgtgtgtgttgggaacattcagtagcctcctatagctatttgaaattacatattgttgttatctgtagaacactggagcttcctcctcctatctggctgtccttttgtatcctttaacaaatctccctattgcctcctcctttcccctacccttcccagcctctagtatcttctgctctactctttacttctattaaactgttttttagcttccacatgagaacatgtggtatttaactttctgttcctggcttatttcacttaacataatgtcctccagtttcatccatgttgttgcaaatgacaggatttcacagtttttatggctgaataatactccattgtgtatatattctccattttctttctccatctgttgtacacctaggttgattccatatcttggctattgtgaatagcatttaacactgttatgaaggaatacctcagtctgggtaatttataaaagaaagaggtttatttggctcacagttctgcaggctatacaagaaccatggcactggcctctgctcagggagctggtgtgtgcagagatcacatggtgagactggaagaaggtgggtgtgccaggctttttgtaacagtcacctctcagggggaactctggtaggaaccaataacagtgagaactcagtctccccaagggagggcattaatctattcatgaggcatccgcccccatgtcccacacacctgctattaggccccacctccaacactggaatcaaatgtcaacatgagatttggaggggacaaactatagcactgatgacacagactttgatcactggaaaggttgtgtttgccaggtttctccattatgcattactgcctcctttccacattgtactcttgagaaacaagttgccaggtgaggctctattcaaggtagggaggaggtagcacttacatttacaacatttaaacaatttgcattttctgactcttttttttttttttctttgagattgggtcttgctctgttacctaggccggagtgcattggtgcgatcatagctcactgtaaccttgaactccttggctcaagagattctcccatctcagccttccaagaagctatgactacagatgcataccaccatgcttggctaattaaaaaaaatttttttgtggagatagggtcttgctatgttgtccaggctgatcttgaactcctgtctgtagggaccagccccacagggtcggtgggtttttctccccgtgtgcagagatgagagattgtagaaataaagacacaagacaaagagataaaagaaaagacagctgggcctgggggaccactaccaccaagacgcagagaccagtagtggccccgaatgccaggctgcgctgatatttattggatacaagacaaaggggcagggtaaggagtgtgagccatctccaatgataggtaaggtcatgtgggtcacgtgtcgactggacagggggcccttccctgcctggcagccaaggcagagagagagaggagagagagagggagagacagcttatgctattatttctgcttatcagagacttttagtactttcactaacttgccactgctatctaaaaggcagagccaggtgtacaggatggaacatgaaagcagactaggagtgtgaccactgaagcacagcatcacagggagacggttaggcctccggataactgcgggcgggcctaactgatgtcaagccctccacaagaggtggaggagcagagtcttctctaaactaccccagggaaagggagactccctttcccggtctgctgagtagcgggtgtttttccttgacactgacgctaccactagaccacggctagaccatggtccgcttggcaacgggcgtcttcccagatgctggcattactgctagaccaaggagccctctggtggccctgtccgggcataacagaaggctcgcactcttgtcttctggtcacttctcactatgtcccctcagctcctgtctctgtatggcctggtttttcctaggttatgattgtagagcgagaattattataatattggaataaagagtaattactacaaactaatgattaatgatattcatacataatcatatctaagatctatatctagtataactattcttattttatatattttattatactggaacagctcgtgccctcggtctcttgcctcggcacctgggtggcttgccgcccacacctgtcctcaagtgatcctcttgctttggtctcctaaagtgctgggattacaggcatgagccatcatgcctggcctctgactagtttgaaatgtgagagtgatgatggtttaccagtcttctttccagctggctgaagtctaattaattcctattgatgttcattgtgtattttctgtcagagctcacaacacttagatgcttccttgtggacccgctgaggagctggatcaggccttgccacttgctgtctgagcccgtgtggtcaagacaacccagcttctaggcacccagggcccccttgcctcatgggtgggttatgttcaatagaatagagaatgtccagctttagcaagatttatccaacgtcttgtttttggtacctgataggtgctcagtaaatatttcagtgaatgaatatgcaacacttagctgtatacagatgttccttgacttgtaatggggttatgccctgataaaaccattgtgagttgaaatcattaagttgaaaatgcatttaatacacctgtcctcctagcctaccttgaatgagttcagaacacttatttagcctatagttgggcaaaatcaccaaatacaaggcctattttataataaagtgttgaatatcttatgtaacttattgaatactgcactaaaagtaaaaagcagagtggtttcatatcactgtaaagtctaaaaatataagttaaatcattgtaaatcagggacagtctgtgttaattttgagcttataaaaatggtgttgttttgtatagatcctattatacagcttcagaatcagaggaccttggttaaaatttcagttgtgttactgtcagtactcttgtcatgttacctcaccacactgtctgctgttacaagggagacttgtcatgttacctcaccacactgtctgctgttacaagggagaagccccctttcttcatggagcaccagccgcgcctcctgggtttcatgtctcatccttcttaccttcttagggacctcatctgatctactgtttccccctccccattgtcaccattagtgtctccttctctgctgtcattttcttgtccacactgaaacataactgaagctctttcacctttgcgaacacccaccttaggtctcaggctgctctccagccgttgctggcctgtggactctctcattctctacttttctacctcccgcaggcaattcatttattgcagggtggtgtcccctgttgccactcagactgcacctgccagggtccctagtgacctccttgtcgttaggagagctctaggtaagtcctagacttacctggcctttctgcaatatttgacactgttggccacttcgattcttgaaactcaccctctctttgggttctgtggtggcatcctggtttttctgttaccagatctggctgttccctttcagtgtcctttggagagtccttttcatcctttatattcagcttcttaaaaaattgtgaaagaggccaggcgtggtggctcatgcctgtaatcccagcactttgggaggccgaggcaggcggatcacctgaggttgggtgttcgagaccagcctaacacggagaaaccccaactctactaaaaatacaaaattagccaggtgtggtggcacacgcctgtaatcccagctactcaggaggctgaggcaggagaattgcttgaatccaggcggtagaggttgcggtgagccaagatcacgcccttgcactccagcctggacaacaagagcgaaactccgtttcaaaaaacaaaacaaaacaaaattataaagaacacacttagaaaaagggttacataaaatgtaaatgtgtactgtaatgaaattgtgaaatgatcaacaacccaggtccagtagtagagcatgccccccgccccacctggactcgctgtgggtcactttttttttttttttttttttttttgagacagagccttgttctgtcatccaggctggagtgcagtggcgcgatctcagctcattgtaacctctgcctcccaggattgagtgattttcctgcctcagtctcccgagtagctgggattacaggtgtgtgccccatgcccggttaatttttgtatttttagtagagatggggtttcaccatgttggccaggctggtcttgaactcctgacctcaaatgatccacccggctcgacctcccaaagtgctaggattacaggcatgagccaccgtgcccagcctaaaagtcaacttttataaattatttggaaactagctgacttaatttactctaagtaaaaattggaaaaaaaatttgcccctgtgattggcttctctgatcacctgaagacttcttttgatttgtcctcaacaaaatcagatgcaatattctgcacatagtgtttaacaagtaaaattattaattaaaaaagcttcttactctgggtgaaaaaaacccagtatcgctataaaatagatttttcagaaatttagagacatctgttgtgctggatactgtagaaagatgcttgtgtagttgtggcctcagcttggggaaagctgggcagtcacacccatagtaaattagtaccagtagagtggggcactgctgaaaagatacccaaaaatgtggaagccactttggaactgagtaacaaggcagaggatggaacagtttggagggcctagaaggagacaggaaaatgtgggaaagtttggaacttcctagagacttgttgaatggctttgaacaaaatgctgatagtgatatggagaatgaaatccaggctgaggtggtttcagatggagatgaggaacttgttggggactggagtaaaggtgactcttgttatgttttagcaaagagactggtggcattttgccctgccctagagatttgtggaagtttgaacttgaacgagatgatttagagtatctggtggaagaaatttctaagcagcaaggcattcaagaggtgtcttggatgctgttaaaggcattcagttttaaaagggaaacagagcataaaagtttggaaaatttgcagcctgacaatgcaatagaaaagaaaatcccattttctgaggagaagttcaagtcagctgcataaatttgcataagtagtgaggagctaaatgttaatctccaagacaatggggaaaatgtctccagggcatgtcagaggtcttcacggcagcccctcacatcacaggcctggaggcctaggaggaaaaagtggtttcgtgggccaggcttagggcccccgtgctgtgtgcagcctagggacttggtgccctgtgtcccagccgctccagttatggctgaaagaggccaacaaagagctcatgccgtgtcttcagagggtgcaagcctcaagccttggcagcccccacatgttgttaagcctgtgggtgcacagaagtcaagaattggggtttgggaacctctgcctacttttcagagaatgtgtagaaatgcctggatgtcagggtagaagtttgctgcaggggcggagctctcatggagaacctctgctagggcagagcagaaggaaatgtggggttcaggcctccacacagactccaactggggcaccacctaatggagctgtgagaagagggccattgtcttccagaccccagaatgatagatccaccgacagcttgtaccacgcacctggaaaagctacagacattcaatgccagcccatgaaagcagctgggagggaggctgtactctgcaaagccacaggggtggagcttcccaagaccatgggaacccagctcttgcatcagtgtgacttggatgtgagacatagagtcaaagatcattttggagctttaagatttgactgccctgctggatttcagacttgcttgggacctgtagcccctttattttggccaatttctcccatttggaaaggctatatttacccaatacctgtacccccattgtatctaggaagtaactaatttgctttgagacttgggactatggacttttgagttaatgctgaaatgagttaagactttgtggggactgttgggaaggcatgattgtgtttttaaatgtgaggacatgagatttgggaggggccagaggcagaatgatatggtttagctgtgtccccaccgaaatctcattttgaaatctcacctgttatgggagggacccagtgggaggtaattgaatcatgggggtaggtccttcctgtgctgttcttatgatagtgagtaagtctcatgaaatccgatggttctgtaagggagagtttccatgcacaagctctctctgtcttccaccatgattgtgaggcttccccagccatgtggaactgtaagtccagtaaacctctttcttttgtaaattgcccagtcttgggtatgtctttatcagcagcatgaagatggactaatgcacagcctgacttggggagtttgccgcttgtggttggtgcctagtgtttggtagcggtgcctgaggggcaagtttacattatctggtcttggtgtctttgctttaatagacaattaaaagtagtagaggaacccgtaaaccttggtagacggatacctcatcatgaggttatgttatcaccacacattggtagatacggatgtgacgttacagttttctggtacttttgatatacaaggttacttttcacacgtgaaatcttagggaagtcttagggctctttgaggtgggggtttgacagaggggaagggcattggctttgagatcaggaactcctcctgggttccatagacatttggtgtgacttaatcgatgtcttcaaagtagacatcctgccaaacacactgcctgtgcatgtctgggctctctgagccattcttgctctggtgactaggcgaggagattgatgagtatggcactttatgtgtccactgtcctgagcagtacttggcacacagcacgtgttcagacattgctgtcaataaaaaccaagaacttttatttagagagtttgttacagtgttgtactaatggtgagagccagtcccatccaacgccaggtttcttctgtaatcctgttttcgtattgcgacttttttctttcactgtttttagctctctcctcatctcctggaggaaccggtgataactaaggatatatatgaagttgctgtctctctcattcagatgtttgatgacttggatatgaaggagagtgggtaagagatacttcagttggtaatgcactttaatgtatatgtgatttaaaaaattattcatttggaaacgttttagtgtttttataagaaggtataactataggtacttttttagtagttactgtatatattttaaaatcaggttagtattttggaatttttttaactggaaatatctattttaaataattaaagccatgctgagtgcagtgttaggactgatagttttaaaagctaggatttatagcctgaaaatagtttttccagacatataggggtcttatcactcttaatgctggggtaaaactttaaatcctacattagtagaaactgttgaaactttctttgcatttgttttcatttactataaagacatattcttgaccctaagcaatctccttctgtaatccagatgttcattcatttagctggttctttgaaaattggaacattttccctgaggaacagttttaggttataagtggtgactagagtttataattttaaaaatatggctgggcgcggtggctcatgcctgtaatcccagcactttgggaggccgaggtcgggggatcacaaggtcaggagatcaaaaccatcctggccaacatggtgaaaccctgtctctactaaaatacaaaaaattagctgggcatggtggtgcgcacctgtagtcccagctactctggaggctgaggcagaggaatcgcttgaacctgggaggcagaggttgcagtaagctgagatcgtgccactgcactccagcctggtgacagagcaagactccatctcaaaaaatatatacacacacacacacacacacacacacacacacacacacaccatatgattgagcctttacagcactaattttactacatctgtctccatagttttgccttttccaggatgtcatgtagttgggaattatacagtatgtatccttttcatgttgtcttcttctacttagtaatatgtatttagttccccttatgtcttttcatggcttagatagctcatttctttttagcgctaaattccattgtctggatgtaccttgttcattcatcttccaaatttcctgctatgttctgctttagctgtgtcccattagttctgctatgttgtgtcttcattttcattcatctcagagtattttctgatttccattttgattttttctttggcttattggtttttaggagtgtgttgtttaatttgcacatatttgtgaatttcccccaatttttcctgttacacattttgaatttcattctattgtggttggagaacatattttatattttttctgttcttttaaatttatggaggtttgttgcatgcctagcatgtagactgttctggagaatattacacgtgcacttgagaataatgtcactcattgtttttagatggagtgttctatagatgtcttttaggtatggttgacttaccatattgttcaggtcttctacttcttgatcttctgcctggttgctctatatattatcgaaaatgagatattgatgtcctcagcagttgttattgaattgcctatttcttcaatcttttctgtcagtttttgctttatgtattttggttctctgttgctagatgcatatatgtttatacctgttacatcttcctgattgattcacccatttatcattataaaatgcacctcttatctctcgtaacacttaattttaagacctattttgtgtattagtatagccatttcacttttctgtagttgctgtttgcatgacacatattttttcattcttttactttcagtctacttagtgtctttgcatttaaagtgtatctcctgtagacaacatattctgagtgggatattttttttttttaaagattgagtcttgctctgtcaccaggctggagtgcagtggtgtgatctcagctcactgcaacctctgcctcctgggttcaagcgattctcctgtctcagcctcccgaatagctgggactacaggcatgtgtcgccatgtccagctaatttttgtatttttagtagagacagggtttcaccatgttggccaggatggtcttgatctcttgacctcgtgatgcgcccgcctcggcctcccaaagtgctgggattataggtgtgacaccgcgcctggcctgtatttttaaaattagtctaacaatctctgccttttgattgggctgtttaatccatttatgttgtttaatccatttacatttaattttgtcactgatatagttgaatttatgttggccattttgctttttgctttctggatgtctcatattctttttgttcctctgtttctcttttactgctttcttttgcatttaacacatattttgcagtgtagcattttactttttttttttttttttgagacaaggtctcactgtgttgagcaggctgggtacagtggagtgatcatggctcacagcagcctcgacctcattggctcaattgatcctcccacctcagccttgtgagtagctgggacttagaggtgcgtgccaccacaccctgctgatttttgtatccggttacttttaaaatcacctaagaaggaaggaggcaaaatatgtatttacagtatcttttgttattaactaattacctttaccagttctctttctttgttcatgtggatttgaaatactctctggggtcggctgttttcagcacaaaaaaacttcctttagtatttctagtaaggtgggtctgctagatactctcatttttttatctgggacagtctttatttagtcttcattattgagagttttactgaatacaggaatcttgatcgacagttgttttctctttgagcactttgaatatgtcatcccactgctttctggcttccattgtttcttctgagaattcagctgttaatcttactggggttttctttgcatgtggcatgtcattatcctcttgctgcttgcaagatttcaccttgtctttgaatttcattatggcttttatgacttcctgtaggactgggacaataattgagcctttaataggcattttcatctttcttttaagccacctgcttttggatgcatggtaataccattgaatttcatgagtccattgactactaaactgagctccttggcaggaggccatgctgtgcaggaaataatggaagcgagaaaggcatctttaggtccatggatgggggtatgacaggagctttaggtgcagagaaggcagacctgaatccagaataggatctgtatctatttccatgagggcaaatcagtatctttttcatgatggaatcaacctgtcatcagctggctgggctggtcccccagggaatggtgccatatttgggacttggcactggcccttgctgttgtgtggttggcatccagcagtggtagcagccggatgagtctcatctcaggaaagtgcatggtgttgagtttgtgtgtaagccttcatccctgctacctgtccactctgtgcgttttccaaccctggagggactggagaaggaggctgggtcacgtccacaggcagggcctcttgcccgtctggtgactgaaagccttctccactgtggctgccttatgggcatttcttggtacctctccatcagatctccttattatcagtcttgccatttccacatccctgaccagctgaccaagctattagcctctgcctattgattggggtgaacccaacctcatggccatgtctccttccacccaaagcggtaccaccagatggacggcctcacctctgctaactgggaagagctcccttccccactcactgtgtgtgagcctctcctctgggtggggctgtgatgcagcagatgttcgcccctggttgttgccagcatcccatgcaggcccatctacaaaccaaggctgtgtttttcatggtagtggctgccgcctgaggtcataggtgtggctcaccctcatagggagagatggaggagcagcaggagcagtgaccatggatgctgagctgcctgtgctgcagtgactggtttacccctcacacccctttctcctttgtagtgactgttcccaggcattgcctggattgccactgcatggcttttccatggctccctcctcacctcccattacttccccagagaggcccttcccagccagccctcctgagagcactccatacatgcacctcccttagcactgcttactgtgtttccctgtgtgtctctttaggtcttattgctaaattgaaggtgccttgtctgttttcttgtttcctgtctgtctctccagttagaatgtaagctccaaagagcaaggagcttgtcttcttgttactgctgtatcttacacagaggagggcctggcatgtaggaagggctcacaggttcatggaagaatgaaagttctaaattcacacaaaagtaaatatattgacaatagcaaggaggcaagtagatgatttgagattttggtctgtacaaatcctttctaatagtttggactcatgaacatttaaattttgcttgtagttattttaaatgttttttactttgaagttcttgattacaataactaaatttcaaggaaaacttctgcagatagtaagttttgataggagaaagtattgggagtcaaaaggcttaagtcccctgaatgaccatggggccttggatgttttctcatctttttgggcttcgtgttttcttatgtaaaataaggaacattacattggatgacctgtaagagcctttcaggattaaaagcctgtaatattaggattttagagaagcaatagctgttattagccttcattaatatttgtgcacatcacatttttaacaggaacaaggcttggtcgggggcccagtttgtgttggagcgaagcagtgtgttggtgtttttgccaggtaagaacatcataattttgtgacttggaatcataatactctggagagaggctaagtttgtgcctaacacagattatgaaagatggtattctccataggactttattctttttacactttgagtatgtgaacaaatgtaactttcagtttggctttttattgtaacccttgcatttcttttttttttccttttccttttcctttttctagatggagtcttgctctgttgctaggctggagtgcagtggcacgatcttggctcactgcaacctctgcctccccggttccagtgattctcctgcctcagcttcccgagtagctgggactacaggtgcacgccaccacgcccggcttatttttgtatttttagtagagatgagctttcaccatgttggccaggatggtctcgatctcttgaccttgtgatctgcccgctgtggcctcccaaagtgctggaattacagatgtgagccactgtgcccggccaacccttgtatttctaaaaaagatttcttattaataattaagagttcaatttttttttttttttggagacagagtctcactctgttgcccaggcaggggtacagtggcaaaatcttagctcactgcaacctctgcctcctgggttcaagtgattctcctgcctaagcctccgaagtagctgggattacagacacgcgccaccatgcttgtctagagttcagctttttgaaggcagttttgccaccttcgaaatttccagtaaaatatttggctttgtgaaatttgcattttacatatgtcgttataaatgtgaggtaactgtcatcagtttgcattgaaagcttatttagtaatagtaaaacacactgttattataacaccgtgagaatcatcagggtaatccttgagttcccttctcagtgtttgagaaaacagacttttaaaatacctttctgaaaagatgaatttatgttaaattgtactttttcaaaattacttgatgtttaattcaagtggtatagcttgatgaaacattatgacaataattcaaatattttctgttgtaatatatagagcataaacagatttgttcttaaaataatggagaatgaaaaacatgcaatgaaagtagcttacttaattttggaatgcaacatatgagtttcaaacttttgtcatgttttgcttagctgataaggatttgtttacatgcagggaacaaccatgagctgacagtggggtggtgttgcatgtgccttggtgaatatttatcagatgacttctgtgtgcatcatattgtattaaggggaaaacatcacccaagtagagccatgttgatactggcttaagaacacctaacatgggccgggcacagtgctcacgcctggaatcccagcactttgggaggccgaggcttaagaacacctaacacggacgggcgtgggggctcatgcctggaatcccagcactttgggaggctgaggtgggtggatcacgaggtcaggagatcgagaccatcctggctaacatggtgaaacctcatctttactgaaaatacaaaaaaaattagccgggcatggtggcgggcacctgtggtcccagctattcggaaggctgaggcaggagaatggcatgaacctgggaggcggagcttgcagtgagccgagatcacgccactgcactccagcctgggagaaagagcgagactccatctcaaaaaaaaaaaaaaaaaaaaagaatacctaacatgagataaatactctattttatttattttttaagaaagggtcttgctgtgttccccaggctggagtacagtggtgtgaccccgatcactgcagcctctaccttctgggctgaagtgatatttccacctcagcctcccaagtagctgggactgcaggcatgcacccccatgcctggccaaatttttttttttttggtatctttttgtggagacggtttaactagcttgcacaggctagtctcgaactgctaggctcaagtgatctccatgaagtgatccacctgcctcagcctcccaaagtgttgggattgcaggtgtgagccactgctcctggctggtaaatactttttacctgctaaacattgcctgaagaaaatatttataagtgatattttacatttagggttactgtccttttaatatgttcatgtgaattcaagtttgatagatgtttatgtgtcaattgatcttttgtgaacagttctatagtagttttccaggactgctgtaacaaagtgccacaagctaaatgccttaaaagaacagtcatttattctctccctgttttggaggctagatgttcaaaatcgagttgtcagcagggccatgctctttctgagcctcttcctctttccagctcctggtagtggccgtcagtccctagtgctccttgacctgtggctacatcactcctgtctctgttgtcacatggcattctctgtttgtgcctcttcccttcttgtatggataccagtcattttggattaagggctcaccccattccagtataacttcatcttaactaattacatctgcaatgactctatttccaaataacaccaccttccgcattctggggttaggacttcaatacgtctttttaggggacacagttcaacccataacagactcagatttgagaatcaggatgaggcaaaagcacctgctagcttagctttcagcaaacaggacggaggcctgatggaaatggtttagcacatcctcatgaccaaaactttacaaatgttattttttgattgtaaagattttgcatgctcattatagaaaatttagaaaatctgggggtaaaaaaggaatacaaaaattactcatatagctaacacccacagggagtcactgctgtgtaaaggaaaactggaataatagggtttttccctatatttttgagttactactaatcaatgtcactgtgtacttttacttgtgtttctggcatatttaggcaaagaggataaagaagtcaaataaattggtagggccttctttgaaagatatgccattttaatttaaaggttggtttctagcagtaaatacaaacatgtttatttccctcctccacttttttcttccctaggtctgggtgaaataaattatatgcatgaacttctcacaagcctggttcataaaaggtatgttgaaaatgatacagctgtattcttctaagccattgcattgtttctgccttaaattatctcagtatttatttttgtatctcatgtatatctattctttatggagattttattttagtaatttcttaggttgcaggtctatccactccattcaagtgtggctttagaagaacagaataatgtctttttaagtccagtccctgggtacagaaaggtaggaaaactgggaagacaagttctaagcactttaggtaaattttccttagagactctactcatgaaaaatattttctgggtgtcgtggctcatgcgtgtgtttccagcactgtgagaggctgaggtgggtgaatcatttgagctcaggaatttgagaccagcctcatggcgaaaccccatctctacaaaaaatataaaaattacctgagtgcagtggcatgcacctgtagtcccagctacttgggaggctgaggtgggagacttgtgcctgggaggtggaggctgcagtgacccgagatcacactggtgcactccagcctgggtgacagaacaagactgtctcaaaacaaaaaaaaaaaagaaaaaaaaatcacatttcagcagtgtgttctgtagttagtggttactcacttaaacaaatatttacctaatgagccaggtatgttgtttagttttgtgttttattttgtaaatcagtttgctaaaaagctaagattttttgttttctcaattcaggaattctggtgccttttaattcttctttagcatttctttaactttgggactgttctcgtgtccttgaaaccactctggtgactctggttagaagccatattctaggtcctgcttcaggaggatttctttatctcagattatgtgtgaatgatggagttgttttaacaagacccttctagagctgcttgaggtgatcagggggcctgagttgacaacgtcgccccccttgattgctttggaatctctaggagcagccttgggtggtattctagggcaagtacaggcaacaacccttcttctagaaacctggttgtgcccctgggcaattccaggacccctctccaccccaccaaagttaccacaccagaagtcaggaatagctccctttgcccgtgtcttgtctgcctgtgttaaagcctttgctgtgttgtatgtggctggtttccattcatcaggggcttcttgatcaattgtgatgtgtataaaatagaaaaatggctaattttgaaacctgagttcagtatttacattcagaagctttaaaataatttttgcatttttgtaaactttgcctaatgatgttcggaatatagtaggaatgtcagcttttttctttgatgtttaacagattattctgtccaccaatattgcagagagttctgtcacagttccagatgtcaaatatggtaagatacttctccgtttacctcctggcattagctgtagtgccatatttattggcttattcacctcactcaggaattgttcttctcttccttcccatctcctcccgttttggaacacagaattgagaaaagtaggtttacgtagtttctcccatactctcagttcaccaccacctcctctgagtgtacctgtttcatcctttagggcaagctggctcgtcggaagtgtttggggtgttccactgggccttgtgggaaacagcttcggggctgccaggtggagttctgtgactggagggaggcagatgtggggaggagctcaggccatctcagctctgaaggttgcttggcaggacaccatgtcaactctggagcagcccactttgtcatctcatcttccacatatgtgtctgtaattactttgtgagattgcttcatcaatgagttttctaaattcattaatttatatttgaaaacctaacacatgtgtcgggcactgttctcagtgctggcagtacagtggtgagtaagacaaagtccagtcctcatggctgctacgttctggtgggagagagagatgcttagcaggtaaaaaggttttataatttcaggtacaggtcaatgttgtgtaggaaaataaatcaggggaaggggtacagttattgggaaaaatgatctttcagataggatctttcagataggaattacctctttgaggaagtgacattttaatagagacctggattaaatgaggagcgagctatgcaaaaaggtggctggggtgtagggaacgggtttgaggagcagcacacggccagtgtggctggaatgggtaaaccagggcagatgataatgagcaggtgttttgtctttgtaccagcgaaatagcagtaagcaaaatagacaaaaagcctttgttctcatgacacattcggggtgggtagataagtacagatatggagtaagttacatgatggtgagtgtatgaagaaaaaggggttattgggtagggagtgtcagggaagcaccattgagattgcaggtggagtgatcagggaatgtgacaagtcacatcctgaaggaggttagggagggagtcgggtccatacctggcaaaagagtgtttggggtaggagaaggcaagagtgtgcttgatggttgtgaaacagcaccatcaagcaaggaggccagggcagctggaccagtgtgaacgaaggggaaacgagccagaagagaggcctgggggtagcaggggccatgcagggcccataggacctggtacaaccttgctgtgctgggcaagatggaaaatcgttggtaggttttgaaaacagaaatgacataacctgaagttcacttaacaggatttctctgggaatagactagaatgaggcaaaggagagaaaaggaagagacttaggagggtgtcacaagaatctaggcgacaatgggtggtgcttagaaaaggacagcagcggtaggggacaggaggtgggggtagatcccagggagattctgaaggcagagctggggaggatgtgctgaggtctctgatggagaaattgtgagagacacatttggtcggcctctagacatgtggcctgagagactgggaggatggaggctcctgcgagatggtgaaggctgtggaaggagcagggtggggcaggtgaggagctgggattcgggctgagacgtgctagatgttcaggtggaggtgtcatggaagcatctggctgtgtgagcctggagaccagggccagggagcagctggcgggggcgtcagcccgtgactggcgttggaaggcaggaacctggccaagctcttctgggagtgcacagagggagggtggccccggtgtgtaaaggtgggcagtaagagcagaggggcctccagggcagtgggaagaaagccagtgaacacagaggcctagacacccagtgggaaaagggtcttgaggggatggagtggaggagtgcatcagatgcccatggcgggtcaaggaggacctcccaacggggctgttgtcagtgaccttgacaagagcagctttggtggaagcaagcgtctgcttggagtgggctcaagaaaggatgggaagaaatgaacaaagaaccggtggcggcacacaacactccacaggtgctttgctgtaggggagcagaggaaatggggcagtaagtgaaggggtggcccaagggagtgagtgttgctgatgggagatccccagtgctttgcctgtgtgagggggaaaggtgtggtggaggggaggaggcaggccacagatgaggatactaaagcgcagagacactcggcagcttatccagccaggcacacccacatgcacacttctacccacccacccacccacgcgtacagatgcacagatacacacacccatccagacacacacatacccagacacccagatccacccacaggcacacacagacgcgggatttgaattctggcagtcccttgcatcagctgctcttctgtactgctgttgtaatgatgctcttttggagaacgttactctttcgggtgcagtccaggtaggcctttttatgacacgttgggtcttacgggttatgcattctttacacctagagactccctgtactcagcaagaaaggatgggaccagcaactccccatcctgggcgggagtggtcggtgcgtggccaaacgtttctgcctgttcactaattcttaaggctgcatgtttcaaatggctttatcactatgcattgtgatttattatgcaatgatctcttattagcatggtgtttacagtccttttttttaaatggcagttatagatttttgtttgactagaactttggtctgtgatgaagatacaaattatcagagtctgcgattgagttgggcttctaaaaccagctgtaatcagagaaaaggtaagacatttgtgttaaagcacaataatgagtcattggtgacacagtggcacattcaggtgctttttttttttttttctctgagacggagtcttgctctgtcgcccaggctggaaggcagtggcgcgatctcggttcactgcaagctccgcttcccgggttcttgccattctcctgcctcagcctcccgagttgctgggactacaggcgcctgccaccacgcctggctaattttttgtattttttagtagagacggggtttcgccgtgttagccaggatggtcttgatctcctgactttgtgatccacccgcttcagcctcccaaagtgctgggattacaggcgtgagccaccgtgcccggccattcagatgcttttctaaaaaattcattttttgcactttttacttagatatttcctttcttggaacgagttttaagtttttagcaatggcttctcatattgtcagagtgtccatttaaatccatgcttctcctctcttctaatgtatgaggtctttgtacataatggataaaccccatcatcctgacactatgtttttttcttaaagttaagttaaaaaattattggtgaagaactatggacaccaagtggatcacttcagtaatttttgatgatttgatttctgtttaactttgatcttcctagggttagttttcctaaagtggttctgcagagagttctggatttgctgcatcagccacatgtatcactgggcagagatgagggtgtgtggggtcacttttggggtcttgggatgcttcaactacagtggaggtatattcatgacatacctgggacaggttaagatcacctgtggcaagaactgattttacaggacagcattctcagtgcagactgagaagtggcttttttttttgtttgttttttagaaaaccttttgggaagggtagataaaagaccatttcaagaatactaaaatactaaatacaccccccaaaataataaaggcaacattgattgaatatttaccatatgccagacattcttctaagtatttattaactcatttaatcttcctaacaaccctgtgaggtaacgtacatggtgtgttaattaagatttcccatttcttagtgaagcagttagctgagaggcacagaaatagtaacttgctcaaggttatagtaggaagtggtgggaatgaggtttgaacccagaaatctggctttggtctacattcttaacctttttgttatatcacctctcctgaaatgacttgcctagagaggggttaagagaatgactaagcagctgttaaaatagggtcacagaggccaggtgcggtgacttacacctgtaatcccagcactttgggagactgaggcgggtagatgcctgagcttaggagttcgagaccggcctggacaacatggcaaaactctgtctctaccaaaaacacaaaaaattagctgggtgtggtggctcatacctgtggtcccagctactcaggagagtgaagtgggaggatcacttgagcctgggaggtagaggttgaagtgagctgagatcgcacacactgtactccagcctaggtgacagaatgagagccccgtctcaaaaaaaaaaaaaaaaaaaaaagtcacagaggttctcatcactttggaaaaaacttaagtattgttataaagtgaagagaaaaaaggatattaaactgtaaacacctcactatgtttaaccacctctcccctcaaactttctaaaaaactatgcttaaaaaatgactagaaatagctgggtgtggtggcttgtgcctgtaatcccagcacttcgggaggctgaggctggtggatcatttgaggtcaggagttcaagaccagcctggccaacatggtgaaaccctgtctctactaaaaatacaaaaatttgctgagtgtggtggcacacacctgtaatcccaactacttgggaggctgagttacgagaattgcttgaacctgggaggtggaggttgcagtgagcctagatcacgccactgcactccagcctgggcaacagagcaagactgtgtctcaaaaaaaacaaaaacctcaataaaaagtgactagaaataaatatacaaagatgttaaaagtgattatctttgggtcagtcttgggattataggagttttgtctacctttttgtatattcaaaatttctataattagatatttattataaaatttcttcctctataagatattgcaaaaatagcacatagaatcctttgaatccttctcttatcttcccctggagtaggacatctttataagtacagtcaaccaggaaattgacatagtgtaacactgttagactatacaccttgtttcacaattttacctgtactgtgtgtatggttctgtgcagtttgatcccatgtgtaagtttgtgtaaccactactatgatcagagcacagaactgtcctgtcccactgctatgcaggggtggccctgtgctgcccccttgcagccatacctgcccctaacactctgtctgtcaactggtgacccgtcttcatctctgcagcttcgtaatttccgggatgttagataaatggaatcatacagtatgtaaccttttgaaattagctttttccacttaccatagtgttcttaggagccatctaagccaatacaagctgcacgtagcagtggctcattcctttttattactaagtagtactccactgaacatttacctgtttaaggacatttgaggtttttccaattcttgccgtgtaaataaaacagctgtgaatattcatgtacaggtttttgtgtggccataagttttcatttctctggtataaaaacccaagaatatagttactgggtcatgtggtaaatctatgtttagtttcttttgttttgttttgacacggagtctcactctgtcgctgggctggagtgcaacgacgtgatctcggctcactgcaaccttcaccttctgggtttaagcaattctcctgcctcagcctcccgagtagctgggactacaggcatgccccaccacgcccagctaatttttgtatttttagtagagatggggtttcaccatgttggccaggacggtctccatctcttgacctcgtgatctgcctgcctaggcttcccaaagtgctgggattacaggcatgagccactgtgcccggcctatgtttagttttataaggaactactgtaaactctttccatggtggctgtgtcattttacattccatgagcaatgtgtgagatctgttttttccgtatctttgccagcaccactgttaaaagaaaaattttggccagacacagtggctcatgcctgtaatcccagcactttgggagggtgaggtgggcagactgcttgagcccaggagtttgagatcagcttgggcaacatggcaaaaccctatctctataaaaaatacaaaaattagtcaaccatgatggcatgcgcctgtactcccagctactcagtagggtgaggtgggaggatagattgagcctgggaggtcaatgcagttgagccatgattgcgccactgcactccagcctgggtgacagagtgagatgctgtttcaaaaaaaaaaaaaaaaaaaagaaaaaaattttagacaaattaaatttaacagagttttaaagaacaatttgcaaattggtctgcccctgaactggaagaggtttagagagactctggtgctgttgcgtggtcaaggaagatttatgaacagaaaaaggaaagtgacgtgtagaaaatggaagtgaggtacagaaatggccgaattgactacacctgggcattggtcctctttgaatgtggtttgagcagttggttgcctttgattggctgaaacccggtgattggcataagagtgggttatagtctttttacatatctagttaggttatagtttactatatgcagagagacttttaggctgaacttaaaatatgtaaggaggcatctttaggctaaccttttttcttttcttttcttttttttttttctttttgagacagagtcttgatctattgccaggctggagtgcagtggcgtgatctcggctcactgcagtctccacctcccaggttcaagcagttctctgcttcagcctcccaggtagctgggactacaggcgcgcacccctatgcctgtctaatttttgtatttttagtagagacagggtttcaccatgttggccaggatggtctccatctctttacctcgtgatctgcccgcctcggcctcccaaagtgctgggattacaggtgtaggctaaacttaatttaacaactttcccttttggtcaacctgtcaagattaagaggttgaccaaaaccttaggcattgatgtcactttgtcaccattgtaaatgtgtttatttggtctcagatctccctgggaagagattgagattggctcaatctcttgagccaagagattgagacagtgagttttgtcaggtgggaacaaggactttaagttatttttttataagggttagagtagcggggacctctttatgttgggattttttatttttattagtaggagaaaaagacaacttggtctgttttagcatctatcttatgccttaataaacaaaagacaaagggtagatttagataaaaaattttaatagtacctttgttaatccataatcagtcagaaacaaaacattggttcacccctcttgacctacatcataggttaaagaaaacattgccaagaggccttcacccttctagatagatatcttttgttaggatctagatccccataggtggggaaagaatgctttttgggttgccccatttcttttaaagctgcattttaagactccctcctacccctcccttcactctctctccttggactattttattatgtgttaggataaaagagttgctacttcataggtgatagagtcacaagagagtagtagtttgtgtcatggtctctgtgggccagccttggttctgaaccttctgcttgttcctcactcggtcacgtaatgcggtgtggctgacagctgggagggtgctttgcagtggggcaaggagctgtgggaagcacagggtgctgagacagctcctcgatggcattgtagggcctgtcgccaacctcgtgactttctgttatgtactgtgcattttcaagaagggtgtacttggtttctgttgcatattgggccaaggttgttttcttcagaaatatgcattggattttataatattggtcactgaatagaagtcagcatttagtcttgttctatttattctaattttttaggatagtcattcttatttagaataatgtttaaaataataacttattaagaatacactaatgtattctaaagtttttactgacatagtctggtggaagatacttaaggctttgcttaattaatatttaatgactgtttaaaaagataccttcatgctgatgttaaagtaattaatgccaaacactgtttgcacatctctcctttgaaggccgtgctggacgagtgtctagagggtactgttaccggctggtacacaaggatttctgggacaactccatccctgatcatgttgttcctgagatgttggtaattcactttggtcattgtcaaagtttatttatttatttatttatttatttatttatttatgagacggagtcttgcactgttgtctggactggagtgcactggcatgatcttggctcactgcaatctgcctcccgggtttacgcgattctgctgcctcagcctcccaagtagctgggattacaggcacacaccaccacgcccagctaattttttgtatttttagtagagacagggtttcactgtgttggccagactgatctcgaactcctgacctcgtgatccgcccgccttggcctcccaaagtgtcaaagttaattttttgtagatagttttgccaaatagtctaagtgatataatttctagtgtcatctaattttgattccagaaaaatccttgtcttgccacattccccctcactcacaatctgggctcactattgattacacatcaggctactgtctagggcgttacccacattttacagttttaatgagaggatgttttctggtatctatgggctctataataggattgtctttaaatgctgctgttttctatgtccctttataatgagtaattgtgggatcagctttttttccttcctcttttctgtgtctctccccttcctttgtcctccttcttttttttcttctttccctctccctgctttcttgctctcccacttttcagtccctcttttccttctcttttttcttccttctctctccccatctttttatttttccatctctttctctcctgttctttcttcttctctctcccttctcttctctccctccctcaatcctctccatttttctttcttctctcctctccttctctcctcctctttccctctgaagcactggttatgtgaatcggctaactgatttagttatgttattatttctaatctcaggcttgtttcttttcagcgttgtccattaggaagcacgatcttgaaagtgaaattacttgacatgggtgagccgagagctctgctggccactgccctttccccgcctggtctgagtgacattgagcgcaccatccttctactaaaggaggtaggactgcctgctggttagtactgttggcatctgtagagctgtgttctactgtggctccctcagtctgtgcctcactttcccactaactctgatcctcccgcctcactttcccgctaactctgttcctcctgcctcactttcccgctaactctgttcctcctgcctcactttcccgctaactctgttcctcagcctccttctggcttgcttcatccattcctggaaaccctgctcttcctacttgggattctttgactgcacacctgactcatactctgctctttgaacttgtaaccgaggccttggtacaagctgtatcctagtgtacatactgtgctggggctgtggacgttctgcttctgaccttcgaagttgaggatgcttctggtgttttaccttctttattatgattgattgattgattaactgggtcttgctctgttgcctaggctggagcgcagtgatgcaatcatggcttactgcagcctcaaacactgggctcaagtgaccctcccactgtggcctcccaagtagctgagactgaggtgtgagccaccacacttggctgcctttaaatatgatacctccttgggtttctatgaaatacactgtgtcaagttaaggaagtttttccccatacatagttcagtaaggttttgttgacagtgacagctgggagatccttcacttagtactgtgcatgccatatttgttcaagagtgaggtgagtagaattctgtgaaagtcctttagtgttacctcccaggatcatacttttaaaaaaaaagtaaaatgtgttctaagtttcaagggaaaatttaaaaagttttttttggtaacatatcaacctttcataaattgacttagaatgttattcaccaaaattaggtctttgtttcctgttttggactctccaccttaaggggaagaagtatgagtaagtcagtgcttgataataacactaattttattttataaaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattataggtaagtgtgagaacaaataaatgctaatgggaagtttatataacaccactctcacaatcttacattcttcttgtttattttttatggttagcggcagctctttctttgaagaatttttttgcaatgcctttccggcagcatctcgatggatataggtactgaacattcatattttaaagtgtcactgtattttaatggtattgaatgacactgttatctgtttataggaacaaagtgaatttctctggcagtagcaagagtgactgtattgcacttgttgaggcatttaaagtaagttttctgttgtgtaaaccatgaaagcagctaccacagattgttagtacattttcataccacaaacatatgaggtagagacagacaatgttttatctagtgaaagtattatcagggttattggtgtccagtgttaaattaaccgtgctggaagaagtgagtgaggtggaagtccaattttatgaaattgattgaaaaaattaaatttgtaaatttttatgttgtaaattttcaggtttgttgaaattgtacttaaaaaaaattcagtgagccaacacattattttgaaagtttggatcctttattttcagacatggaaggcttgcagacagacaggggagctgcggtacccgaaggttggtgagccctttcctgctgctttctagatggctgggagtaatgagagaaggactctgtcttggtacagtcatagcgtgtgaatcatgacggtgccacctgcggctggagtcgaggtcactgtcagtgctcgcacggctgtcccaagagtggcaggccataatctccgcagactggtccttttgcttccatcgcttctcgggaggccgcttgctctcaggcctgtgctggagctgtgctgcttgtttcatggctccacattgtactgatcttgccatggtgtctgcagcctctttggctgtatttcatagctgtgggtactgggttggacgtgtcagttcaaaattgagggccatgtggctgctgtttctgttttcagctcttttagataacgggcttaaaagaaatgtaatctgttaccctccattttattgttttttttttttggtcaggctttgctgttcttctaaacttatttggttcaacagactgtttacaggtctgccgtttctgtgtggagatttgctgtgcttagatatatctctaccaatacatatatgagttaggtgtttaaagtcttttttttttttgagacggagtctcggtctgtcgcccaggctggagtgcagtggcacgatcttggctcactgcaagctctgtctcctgggctaacaccattctcctgcttcagcctcccgagcagctgggaccacaggtgcccgccaccacacccagctactttttttgtattttttagtagagatggggtttcactgtgttagctagggtggtctcgatctcctgaccttgtgatctgcccgcctcggcctcccaaagtggtgggattacaggcgtgaaccaccgcgcctggcttaaagtcttttaaaggctcagctgtagtatttttcttgttggtatataatttgtcagacatcttttttcaagataatcaagttatgtctacctttaatttttgagacaggtgaactcagaagagtttctgtattgtgtttatggttgagtattacgctctctggcttcaatgtaaaattggatgtacctggagagggagtgccactgtcaacttgagtagctcagtaatttacattcatcattaaatttttggatgaaatatgtattaaagtagctaaattcagctctaatttattaccttaatattgagtattctgcttttatatatttaaaggatgaacttaattggggacggttaaattacattcaaatcaagagaattagagaggtaagttaagttttttgaccaaatggatgcaaataaagttgacttatgaaatatttattaaatgacaacaatatttattaagtacgtgggtagtaatgagtattccaagaagtgtatttcctgcctgtttccagctttagtaggagtgtctcttgtgttttcacctttcagtagaactacttgggtttctaataaatactccttttccagttaaggaatgtatttcccctatgtatactttaatgaggaatggttgtgtcatcttgttgtatgtcttttcagtatatgtcaggataaagagattgggtgtcgtggctcacacctgtagtcccagcttctgggaaagctgaggtgagaggtttgcatgagcctgggaggcagaggcttcagtgagccgtgatcgcaccaatatattctagcctgggtgacagagcgagagcctgtcttgaaaaagaaaaagataaacatatggtattttaattttttacccactaatacaatcttacattgcttaatgacaggaatacattctgagaaatgagtaattacatggttttatccttgtgcaaacagcatagaacatacttacacagacctagatggtatggcccactacacgcctaggctgtatagtgtagcctatggcttctaggctgcaaacctgtacagcatgtgactgtattgaacactgtaggcaattacaacaaaatggtaagtatttctgtacctaaacataactaaacatagaaaaggtgcggtaaaaatatggttataaaacagggtttcccaacacctgggccatattctccttttgagaatataactaataccagatctcaggtggagcagtttcatcctgaaaccatccccatctactccggcctgtgggaaaattgtctttcatgaaactggtccctggtgctaaaaaggttagggatcactggtataaaagataaaaatggcataccaatatagggagcttatggtgaatgcagattgcaggactggaagtggttctgggtgagtcagtgagtgagtggtgagggaatgtgaaggcccaggacaccactgcacatgactgtagactataaacagtgcagacttgggctacactaagttcataaaaatttttaaaaaattaattgtagcttaatataactttttttaacttgataaactttttaattaaaaaaaatttttggctcatattaacacttagcttaaaacacaaacattgtacagctatgcaaaaatattttctttctttatatccttattctataagtttttatctatttccttatttatttggtttttgagctaggatctcactctgttgcccaggctggagtgcaatggcatgatcacagctcatagaagccttgacttcctgggctcaagcaattctcctgcctcagcctctgcagtagctggaactacaggcatatgtcaccactcgtaatttgttttttctttctttcttttttttttttttttgagatggagtcttgccctgtcacccagggtggagtgcaatggcacagtctcggctcactgtaacctctgcctcccgggttcaaacaattctcctgcctcagcctcccgagtagctgggattacaggtgtgcgtcaccacgcttggctacttttttgtatttttagtagagacagggtttcaccatgttggccaggctggtcttgaactcctgaccttgtgatctgcctgccttggcctctcaaagtgttgggattacaggtgtgagccactgtgcctgtcctaattttttttattcttttatttttttgtagagacagggtgtcactttgtagcccagactggttttatctattttaaaaaataatttttatttgttaaacttttttgttaaaaactaagacacacatacacattagcctaggcgtacacagagtcaggatcatcagtatcactgtcttccgcctccacatcttgtccactggaaggtcatcaggggcagtaacacatggagctatcatctcttacagtataatagtgccttctcctggatacctcctgaaggatacctgcctgagactgttttataattaactttgtttgtttcctttttttttttttttgctacttctttcaagacatgtgaagttaatttaaaaaaaaaataggagtatatactctgaaataatgatggtatagtatgataaatccataagccagtaacatagttactatcattatcaagtacagtcatcccttggtattcactggagggttggtttcaggacccctgtataccaaaattcacgaatactcaagtcttacagttggccctgtggcgcccatgtgaatagtcggccttccatatactcgggcttgcatccctcgaatactgtatttttgatccacatttggttgagaaaaacctgcatataagtgggccctcgctgttcaaccccatgttgttcaggggtgaactgaaatgtactgtatgtgttgtatgtgctagactttcatatgattggcagcacagtaggtttgtttacaccagcatcactgcagacacgtgagtaaacgtgttgccctacaacagctatgacgtgaccaggcaacaggaattttctagctctgtgacggtcttatgggtccacagttctatacgtgtccatggtcaactgagacactgctatgtggtgcatgacttatacatgaatacatgatggatttcccactgttgacccagccacgtgttcttagaataaactctgcttgtttgtaatgttttctcccaaaacattgctcggttctgattgccaatattttctctagaatttttgcctctatatttataagtgaaattggcctctggtttacgtgtgtgtgtgtgcatgtgtgcgcacatgcatgcacaatactatgagatgttgttattgataccaccctggtaggatgaacatctttctgtacccaggaaccattttaatcaacagtttaataactagaaatgtatttcttacatatttgatagaacacattcaaaaacacctttgggattagtgcctttttgagggatcaattttaaaaaaaatttcaatacccctggtagttactgatccattctggattctaattcttctggagtcatttttgatgagttacgttttttcattcaggtacccatttaatccagatcatgaagtttattgatgtatagttacacgtaattttcttaatttcaaattcatgtcaactggtaacacctttcttgttcttattgttgtgtatttgtgtactctcattgtttcttgattatatttgtatattcagggagtccccaagaccatcctcaggttcactgattggctagaaggactcacagaagtagaaaagctgttatgcttatgcttatgatttattttagccaaaggatatggattaaaatcagcaaaggttaaaaaaaaaaagtgcatgggaggagccctggagagaccaggtgcaggctaccaggtgtcctttcccagtagagtcttatggacagtgattaattctctcagcaacagtgtgcgatgacaggcatgaagtattgcaaccaggaagctcacctgagccttggtgtcctgggtttttattgagcactggttatgtaggcctagagtacccatgtgactgactttagttactcagtcttcagtccctccagaggaaactgttaccctcatggcccaaggccccaccgtcaatcatattctagcgtgaactcttttgtgtggcccaaggccccaggtcagcatgcatactcttatccaggagggtaagagtccctggaggcttggcaatgacctttcaggagctgggccagggccaagcctttctctggaatgtgcatggtctggacagccaggcctgctggattactcctttactgcagagtctgcaagatgcttcctttgtgttattgtattttcagagagcttactcttagtttcatttgtcagttttcttgtgtatgttttttgggagggaaggagtaggtgtgggattctaaatcattgctttttttttttttccattaatttagttctcctttgacttttagtttacttcagtctttctgaaattagtatttattattaataataatattttcagtctttctaattaaaagcatttaaagctatgaattttattatgagcagctttagccaccacatcctattgatttttgacattcctgtctataatttcttttagtgttggtttcctctctgactaaagagtttatttttattttttagagacagggtctttgtctcccagactggaatgcagtggcataaccatagctcactgcagcctcaaactcctgtgcttaagcaatcctcctgcctcagcctcctaaagctctgagaggtgtgaaccaccgtgcccagccctgaaatgtttttaaatatctttttgttgttgttcatttctgattttattgcattttagtatagagagtggcatagtcttggtttttacttagttcacttacatgtgattacagtcacatgaaacagttccatccctcaggggtacagaggcgagcatctgagtgtgctctcccttgcttcccatgtcccaggcttttcctccctccacagagatagtggctgctgagtttttctgtcctttcaattctttttagttgttattccccccagttatgttcacacttgtgactgtattctttttgtaattgagatacttttgtggtgacttaatttatgatcagttcataggtatttggagttgtgtattttcatgtgtgtacattaaagtttgacattttgtgtgaaacagtttttattacaactggatattgattttattttcctgttcggagggactatttggccataggtcacttactttgtttttaatcacaaaagccgtacatgttcatggcagaggctgggacgtgtttcaaggatctaaagcaaggctgtggtcatggctctctgctattctgacctctgggtgggcacagttatgcgtttgcattggttcccatctcaggggtgtgtgtttataaacagatcagggagcatatatgattttgtattctggtattttctctaagtgttatattgttcatccttaacattacttattaattaatttctaagaagatgattcttgccaggcatggtggcacacgcctgtattgccggttgtttgggaggctgaggctggaggatcacttgagcgtaggagttctgggctgtagtgcgccatgctgattgggtgttgcattaaacgcaacactgatgtggtaacctcttgggagccagggaccactgtgttgcctaaggaggggtgaaccagccaagttggagcaggtcaaaactcctgtgttgatccgtgtgggattgtgcctgtgaatagccactgcactgtctagcctgggcaatatagcaagatcttgcctctaaaaataaattttaggccaggcatggtggctcacgcctgtcatcccagcaccttggggggccgaggcaggcggatcatgaggtcaggagattgagaccatcctggctaacacggtgaaaccctgtctctactaaaaatacaaaaaattagctgggcgtggtggtgggtacctgtaggcccagctactcgggaagctgaagcaggagaatggcgtgaacctcggaggcagagcttgcagtgaaccaagctgtgatcgcgccactgcactccagcctggacaacagagcgagactgtctcaaaaaaaaaaaaaaaaaaagataataataataaaaatttttaagagattatttctttttttttttggagacagaatcttactctgccacccaggctgtagtacagtgacacaatcttggctcactgcaaccgctgccctccagtctcaggtgatcctcccatctcagcctcccaagtagctgggactacaggtctgcgccaccacgcccagctaactttgtattttttttgtagagactgggtttcgccatgttgcccgggctggtttcaaactcctgagttcaagtgatctcccaaccttggcctcccaaagtgctgggattagaggtgtgagtcaccgtgcacagccaaaagatgattcttaattagctgcagtgtttcattctgtagctgtgtttatactttacccgttgtgcacttattttctagtgttttcactgctctgatgacatatgtacctttgagacatcagatttcaatgtatttttcttaggtggctgaattatatgaagaattgaagactagaatctcacagttcaacatgcatgttgattctcggcgacctgtcatggaccaagagtatatatataagcagcgattcatcctacaggtgtgctgaagtttcctggatattttttttcctgattctttctgcttacaaggtcttgtggtcgagaaactgcttattcctgctttctgatacaaaccaaacctcaaaggagattttaggtccatagtgttcatactgcgtttgggaaccaggaaacattcttctttcatagtttgcattatttgttgagttgatgattcacctagagagtatttattgtttatttattaatatttaatggattcagacccatttctaatttccaggggagtgtttctatagagtacctgtgttatcactgcttcaggagagatccttttgttttagcttttaagaaagtgaagtgctctttatatcgttcagtgtatatagctattcccctacactgaaaatattattttaactttggaggccatggattcaaattactagtagttagctggaatgtagcgagtgagaagtgtgtcctggccagtggagactgcctctgctgtagggtttcctagaagggttggctgatgcatacggaatcaggtttgaggtagatgcctataaaccgggtgtgctggaaatgtgcgagtgttttcctggatgtaaaattgctctaaggctgggggagtctttggtgggtgtgtttcaaactggtatgtttttattgaagaagggactctttgcagagtgcattttagaggtgaatagtggatgccagcctgctgccctaaatctgagtgctccaattggagttttatctgaacatctgagagtaccttgcacatagatgtgtgtggggagaagtggagaaagttggccgaccttggggctttgtgtgtaggatggtttatgtccttgttcaacttgccactgtttcccaagcctcattctgagaagtactcaagctcttttgaagaaagatgtttctgttaggtgaaaaaagtgtttattttttagtgtttctgttagatgaaattaccagaattgtgactttctgcttggttggtgaaaggtctagttttccatacaaacgataaccatcttttacatttatggatgtcatatcatgctgggttgagattagtatattggtgagaataactgataaaataatgctgttacttcatgaaaataaatttctttttcaggttgtattggcaggtgctttctatccaaattactttacttttggacagccggatgaggagatggcggtgagggagctggctggcaaggaccccaagacaactgtcgtggtaggtgctgggggcaggccgtcctctctggggtgtggtggggcagaacatttttgttctctaattgtttctattcttgtgagtcctaagtgaattttcccctggcgtgaatattaggcttgtttggccttttcaggtgtatctaggcttgtttggccttttcatgtgtatctacttgtccctcagtctcttgcctccttttacagacctggccttataaggaagccttgagagtttatacgttcaaggtcaatgctgatttgatcatgtgctattttgaaggatttaaggcacttacaagtttaagaacattttcttaattcacaacttcatttcatacaaaataaaatgttattggttggcagctgagtgctgtggcttaagccagtgaccccccgacctggatgcccaacagaactacctggagagtgcttattttatttatattcgttgaaattcagatctgaaggctctgcgagatctgagctagaaagtatgccctagaaatcagcattcaagtagtgtgtactttgggcatatctaatgatcagccacaggccctgaccattgaatcagcgtttgcaacccagttgtttaaagcccagcagcagggagactcacactggaagaaagctgagactggactgttttggatcacttggttccagtatgtgcctgtatctgataaggcggggtgagaagcgcttgaagttccttcgtgtcatatcgtaagggctcagtcattgccagattttatcctggttattgttacaccaccactgttagtcctgaagaaataaatagctcataaggaaagggcgcagatgacttgagattacaactggaggtctttgatgagcaccaaaaggagctggtgctctggagatgagagaggcagctgagatacacttgatacccgtggaagggactttaaaaggaagtcattagttttttatagctactgaggatcatttgattggcacctctgctcctgctggccatcaggtttgactaagctctttgcttggcttcctctctcacccctctgccccttcgtggttttcttccctcagctgtgcgcaagaggaagggttctataggtctcttcctcagacgtctagtagctatgcctgcatccctcgaccacagagagcctagtctgggggcccaaaattacctagtgtgtacatcataaaagctcaataatagctggctttacttagcacttgagaggctgtgtgttaggtacttttcattcttctctgagcctcactccaccctttgagttggggatttctcatgtcattcttatttcatgatgtggcagttgggtctcagggtaactctgtaacttgcctaaggagacacgcggattcagggagtgaggagacaggatctaactggatctgagccccagcccatgccttcacttacatgccttctgtcacggagccccgtgcagagctgcgctggcacaggagttgtcctggtccagaagaaagtatggagtgctttgcagaaacccagcatggtaccttgagagtttatacattaaaagtcactgccaatttgatcatgtgctatttggtctttccactgtggtgatgaggaaatacatattcctctcattagttagacattttcctttaaagtttacattcccattattccttatgtagaaatatgttttgaaaagaagtatttagtaagcttgattattttaagggaaaacagaagtaaacaaatcttaattttgctgtattagacttacaccattttaacagggttagaattagcctttatttaacatatttattatagaacttagttagaatttaaaagtctttaaatgcactgatctgtagagtttatatattatggttaaagatagtaaactatgtttttagaaactaaaacagtgtgcagcagctttgagcttgtgaatgttgaaactattttgttagctctagtaatctgctctgattttgtgttatattttacagttgaaacacattcctccctatggatttctttactataaacaactacagtctctctttagacagtgtggtcaagtcaaatccattgtatttgatggtgcaaagtaagtatatttttgtaatcaactgcaattatgaaggaggcataatgattcaaatgtttccagacgctgattgttaaaacggagtgcccatggaaatgggtcctcctatgggctgctgcaattggctttcagaatgtagctttggtttatcttatggtcagaagcaatttgtcttctctttctgctaagtgacctcctaaaggaactaagctgctggttagtggtcaagcatggtcactccaagaaggctcagtaactcagtgtgatgctaaggcggattctcttaaagtgatcttcactttcacgcactggtctgagattttctcagtgagtcattagtaagagttattttgtgggccatgaaggtgatccaaaatagagtgtatctgcttatagttgtctaaagcagatatgttttgaatatttttggaaggcaaacattgtaaaaactcaatttggctctacttactgcatgtaaggaacaaatgtgtgttttggagcatcactgagtttttatttctaacaggaaatgtttatgtaccaaaaagcctaaagtaggatttttaatttttaaagttagaaattttttccagtgttctgtgaatgttgtataaatttttatttaactttacaaagctttgtaaataagaacaaacactttttctttaatgtccagttcactcaagttgaacattaagtccattttcaatttggggtaattccctccggcattttaagttccatttctatgattaatatattgattttctttgtaggcctgtaaatgcttcatgaggcaaacacacaactccctaataagcaaaaccttcctaagtgctttgaacaactcttagagaattaattaaacttgtagtgtctgaacttttcttaaatattctgatgtaaattatagtaagattcttagtcacatatataaagtaacttacttaaagctggaatcacacagctaaactcattcctgaatagtgtgcgtctgcttacctgggtgagcttccagttctgcatggatgctcctttgactgatttgagtggtcagaaggcttggctcccagaagattgcagcatctttgttccctcttctttacaactggattgggttctgtgtttgttgcctgttcttcttgcctgggacttttttttgttttattatttttatttatttatttttgagacagagtcttgctctgtcatcaggctggagtgcagtggcacaatctcggctcactgcaacctccgcctcccattgcctgggaccttttttataggtgtttatatcttttgcattcctcatatttccagctctcaagtcataatacaaatgtcataccaattttttgggggaagtaacagtattctttctgtaccagtaccagttcttgggattcaagtatttaaaggcaaaggaagttacagtgattgaaagaataagaagtgtatttcttttggcatagagcaggggtgacttcatgtagactctgtgaggtgccaagggcgcatgggcagatgggcacaggtggtacctgggcatatcatgttctcccataagaagctttcaacttcgtggtaggagtggagagtcaaattagtttcacagacatttgcctgctgtgagatgtcatgggaaaggcctagaaggtcagaagaagacattctatctgaggcccaatattagagcagtaacattaatttgagacttcctcgggtagacgtcggagggttgtgaggcctcgggctggtgcagtggccagtgcagaggtggtgcagtagggtcaggtggttttccagcaggaggcagtcattagctgatcttgacaggggaaagctgagactgtgcacacatagctggtagccgtttgggcagagctgctccgtgtcagatggagtctgttttgtggaggtcaggtgctgactttgagacagtcttctggcagactgatgagtgtgaacatgactaggtgggcacttggagacctttgagtggtctgtccggaactgtgttttatggaacttactcagggataagcggaaggtcaaggtaagaggagtagaagccggcctggagtctttgcagtagtccaaagcagaggtactgagatgtgcagccagtatggtgctgttggacatgaaaaggagccaacagacgggaaggaggatgtcttggatttgcctggtgattgcatgtggggggcaaagaagtgagaggagcccaagagcatccggctttccagcctggatgctggggaggatgcagcttcgaggagaagacgctgaggtctggagtttaaaattacttctacggagtcttaggagagactctaaagaagggagataaagcagaagggcatgaatcaggcagtgggtggaaggaaaatgcgtgcatttatgagtgaagaggatggggcgtgaaggagagcggaggaggcggagcgggtcagggttgattcatgtacctgctccacacacctcccctgctgggcgtctttccaaactgctcaaggtgtacatttccaggagagagctcattacaggacgatttttatagtagaggaaggggcccaggtctgtttttgtggctctgtgatgatgtggggacccaggggcattagaacttgcatgcatagcaaggtaaacttgatgctgtcttccttctgcctggcacatccagcaggcaccttttgctccatgcctgctcctcatgccccagagtggggctggaatgggacaccgaaatatgggctggggcaagagagggcatttatcaatattacttggtgttttattctgttctctcggtgctataaagaaatacctgaaactgggtaatttataaagaaaagaggtttaattggctcatggttctgcaggctgtataggctgctgcttctggggaggcctcaggaaacttacaatcatggtgaaaggcaaagggaagctggcatttcttacatggctggagcgaaaggaagagagcaaaggggaggtgcttgtaaacaaccagatctcgtgagaactcacaagaacagcaagggggaaatcgcgctcacaatccggtcacctcccaccaggcccctcctccaatattggagattacaattcgacatgagatttgggcagggacacagatctaaaccatatcacttggcaatcaatttatatcacttggcaatcaatttatatcacttggcaatcaatggttttggcccaggcgctgtggctcagtcctgtaatctcagcactttgggaggctgagatgggcagatcatgaggtaaggagattgagaccatccgggccaacatggtgaaaccctgtctctactaaaaatacaaaaattagctggacgtggtggcacacgcctgcagtcccagctactcgggaggctgaagcaggagaatctcttgaatctgggaggcggaggttgcagtgagccaagatgacatccctgcactggcgacagagcgagactccatctcaaaaaaataaataaataaataaaaataaatttaatgctttttttgaaggggaattacaaagatcactgagctatatacatttgtgtggttttctgtatctgttttattttatgatagtaaagaaagacattctgttataatcatgaaaattcttttgcaattatgaaagtaattatgaagtaagatttctttgccccaaattccatgtgactttagtgtttattctgcattatattatacaaggatgatacttggttttggtttaatgacatgtcattataacttttatttctcttcaattaataattttccattggagaaattaatacatgttattgattaattataaattgaagagttactggcattttgaggagagatgtgacagaatttctgtcttgagagaaatgaatatgcagtttttaaacagatgcctgataaatttatttttaaatttacatttgtggaacagagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaaggtattttcgggagggaggtggcagacaggccgtgcctgctttcacattctcaggtgctatttttacatgaccgttgatctggcattgcttcagatcatggtaaaagcactggcttggctgggtgtgggggctcacgccactcatccagcactttgcgaggccgaggcaggcagatcacttgagcccaggagtttgagaccagcctcgccaacatgatgaaaccctgtctgtactgacaatacaaaaattagccgggcatggtcgcacacacctttaatcccacctactcgggaggctgaggcaggagaattgcttgaacccaggaggcggaggttacagtcagccgagattgcaccactgcactccagcctgggcgacagaacaagacgctgtcttaaaaaataaataaataaataaataaataaataaataaaaaagcactggctttgtggttgagtggagctgctgttgaatcctggttgcatcatctcctcactgtgtgcacttgggcacattacctaacctctctgaacctcagttttttttctgtttaatagaaatgataccagccgggtgaggtggctcatgcctgtaatccttgcattttgggagaccgaggcgggaggatcacttgaggtcaggagttcaaaacgagcctggccgacatggtgaaaccccgtctctaccaaaaatacaaaaaaattagccgggtgtggtggcgggcacctataatcccagctatgtggaaggctgatgcaggacaatcaattaaacccaggaggcagaggttgcagtgatgagctgagatcacgccactgcactccaccctgggcgacagagcgagactccgtctcaaaaaaaaaaaaaaaaaaaaaaaaaaaaaaggatacctatggtgtaaggctgttgagaggattgagtgatatcattgatgtaatttttagttaaatagtagggattaaatctaatgttaatttcctgtcttcctagataggattatgcattttgttttgcaaattctctttttaagtaatgtggaatattttttgtcttcaacacagcagtcagtgggacataatggagatgcagctgggagcacctagttgcttaccagtgtaagctgcccttccttgccaaatggcatctttccctcccgcccagagagtggtacagggccagggctgtctgtagggctggtcagcccagggcaggagcacttgctgcatgcagctgtcataaccctggtggatcttcttctcttggaccaaactgagtcacccatggtatttgtgacagactgcttgccttttggccatatccccatagtcacctatgtgggaagtctcatttattatttcttaattgtagagttttcagttctgggaggaacttaacaggaatctgaggagttggtggaggaaggcaaatctgttccatctggtttcacccagtgtgtgacttttggtttctgagagtttgggagtgtagtgggttcagtccttcatgtagagaaggcctgtcctgctctagtgaggtcagactccacttacttttgtaatcgaatgctggggagtcactcattgcctgagtcactcattaaaaataggtctggagattgggaaaagagttggatcaagatctttcttataattctttctcttcattttagaataaagtattaggaaatttttattttctgtcaaatttgtcttttgtattccagaagtttagcatttactatcttattgcctttaagggaaaatgatatttttggggtttattggaaagtcatgtgtgtgttttctaacatagcattgagccaagcgtggattcttatagttttctaaaggtcaaggtgcacatttgaaaacacaagttaggaaacactgcagataattctaaatctcagaccttgaaagtctaaattgataatttatttatcttgataataccttgaaagtagatattctctgagagtcttggccttcacaattatatactacttggagggtagtatataatttttgggatgtgtaccccttccagagctcttcaaaaagccagcagaaattcatgtttgagatgaaatcaaatttgtcatctctggcttaggtattttattgaaatgttcttttcttgtagaaatattagaatagttcaagtgataatttcacatatgtaaatgtgttttctttgtaaaacttgatttttattttaataaaaattcgtattatgtagggtgaatgtggacttccagaagcagacggtagatcctatgcaagtctcctttaacacatcagacaggtcccagacagttacagatctccttctaactattgatgtcacagaggtaaggatgaagtaattgagcttttccttcttcttaatctaaaatcatcatgttgtatacaggaagtttacacacacacacacacacacacacacacacacacacacacagaacttgtgcaccttggtaatcttgttaatgtgggtgagtttgaattatcactctacttgttaaattgaaatatgactaaaatggaaattgaaacatacttattctagaatcaaagttaatttttaaaatatcaagtacatttaaaatgctgaaataaatcagatttaacaagatacatgttagaggaaaaaaaagtgtgtatatttttgaaacaaagtcttgctgtgttgcccaggctggagtgcagtggcacgatctctgttcactgcaacctctgccttctgggttcaagcgattcccctgcctcagcctcctgagtagctgggattacaggtgtgtgccaccatgcccgggtaatttttgtgcttttggtagagacggggttttaccacattggccaggctggtctcgaactcctaatctctagtgatctgcccacctctgcctcccaaagtgctggcattacaggcgtgagccactgtgccccgccgaaatgcttatatgacctcagaacctttatttatgtaagaatgagtcttgtaccgccaagaaaaggatatattccacacatttccttaccttagttcaccaggggaccccctctttttgtctcataaacacctgttaaaaacctgtaaatacttatgttccgaggattaacgctggtgaggtgtcgtacagcacagggtgtcagccctatgattcaagctcattttcctccttacaaaagtcctttctagatttcatctcttctcctcctcttcctttttaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtaggtttttctgtaacaagtcactggaagggaaatgagacagacagacgtacagcagtttatcaaatatcttttataattgtaggtggaaattaaaataattgcagttagcaaagtagtctgtttccctcattgatatgtggatttaagctcaggtcactccaagaattctataattataggattagagcagactgctgcattgctattgctcaggtagggcattgtttttgaccccgtcgtaaagtgtatacttgctttattttctaggtattctttgtagattatggcaataagtctcatgtagatctacatcttttgatggagattccctgtcaatttcttgaacttcctttccaggtaaggtagagaagactctagggaatgaatgctgcatgctggacaggattcctgggtggattcctgggtcatatggtgccctgcctcggcttacagctaggggagccaaggcccaggacagggagggacttgctttgtcacaatagccaaatttggtttctgctcttccaaaaatacatgaaaggattcagatttagcaaaaaaagttgttttaatccagtagtatcttctaatactgtttctgagttttctggttatgttgaaaccagacagactttttaggtaggccacagacatagtcacacatgcccttaccatcagtatgaagacaatctaaaaattattctaaatatttcttattgttgttaaaaagcaaaccaagtttctttaggaaattctcactaccccaacattagttttattgggacttttatgagaatattattgaaggtacatgaacaaggtctgttttcagtggtatttgggatgagtgttttgcttatttataaagctgtttgagctgtgcccttctgtccttgtaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaaggtgtgtgctttcgccgttgctggagcacgcgtttgtgtgagagagaacggggcaggctttccttcctctgtggaccctgagataggaggaggcggacagtgttcctcttcaccatttggtttgctgtacttgtgttaagactggtggcaccaatttaaatgtcttctagctttctctgagactaaagtatggtggctgggtattgtttttgttggtgagtattgtatttgtttgtctcctatttagcttatttttaaaaattatttatttatttatttaacatattttttagtagagatagggtctccctgtgttgcccaggttggtctcaaactcctgggcttaagggatcctcctgcctcagcctcccagagtacttccaggtgtgagccactgcacccagcctcctattcagctttttatcttcttaggatagatttgaaaatgttctatatatgtggggagttttaaaaatggattccaagatttatctccctaatggaagtagttaataaaatatttcaaatatttcaagcatttcaaaacttctttcaactgtttctttgaaaatcagtgttagagttatttttcacgatttaaaggtttgagaggccacttctttttccttttttagttgccacataatcattgtacatatttatgggatatagagtcatattttgatatgtgtatataatgtataatgatcaagtgagggtaattagcaaatctgtcacctcagacatttattatttctttgtgttgtaaacattcaagaactttcttctagctttttgaaaatataccttatagttaaccatatttaccccacagtgctgcagaacgcaagaacctattcctccaatctagctgtaattttgtttgttaaccaacttctctctattctccccttcctgtcttacccagcgtctaatacccacaatcctcctctctacttccattatttcaatttttttttagctcttactcataaatgagaacatgtcatatttatatttctgtgcctgacttattttacttaacataccatcctccaggctcatccacgttgccaagaatgacaggattttttctttttgtagctgaatggtattttattctgtatatactgcattttcagtatccattcatctgttgacggacacctaggttggttctgtatcttgactattgtgaccactgctgcagtaatcacggggtacaggtatctctgatgtactgatttcctttcctttggataaatatccagtagtgggattgccagattgtatgttcgtactgtttttagttttttgagtaaccttcacactgttttcaataaagactgtattaatttaccttcccaccaacagtgtataagagttcccttttctcagcatccttaccagcatttattttttgtctttttgataatagccattctaactggggtgagatgctatctctcacgatggttttgatttgaatttccctgataattagtgatgttgatcatttttcatatatttgttggttatttgtatgtcttcttttgagaaatgtctgttcagatgctttgcccactttttaattggattatttgcttttttgctgtttgagttccttgtgtattctggatgttattcctttgtcagatgagtagtttgcaaatattttctcccattctacaggttgtctcttcattttgttgattgtttcctgtactatgcagaaggtttttagtgtaatatagttccatttgtctatttttgttgcctctgctttttgaagtcttggccataaaatccttgcctagatcagtgtactaaagtatttctccttgttttcttctagtagttttttatagttttaggtcttacatttaagtctttaacccattttgagttgatttttgtatatgtcaagagataggggtttagtgttattcttctgcatttagatgtccagttttcccagcaccatctattgaagagactctcctttccccaatgaatgttcttggagcctttgttgaaaatcagttgcctgtaaatgcgtggctttatttctgggttctctattctgttccattggtcatctgtgtgtctgtttttatgccagtataatgctggtttggttaccgtagctttgtagtgtatttctaagtcaggtactgcgatgtctcttgctttgttctttttgcttaggattgctttggcttttggggtattttttggttccatatgaactttaggattgttttttctatttctgtgaagaatgtcattggtattttgattggagttgcattgaatctgtagctcgctttggatagtatggtcattttaacaatataaattcttccaattcataaacatgagatgtcttaatcatttgtgtcctcttcaattgctttaattgatattttgtagttttcattatagagatcattcacctccttggttaaatatattcctcggtattttatttttgtaggtattgtaaatgggattgctttcttgatatcttttttagctagttattggtgtatagaaatgctactgatttttgtatactgatttctgtatcctgcaacttttctgaattcatttatcagctctaaaagctttttggtggagtctttaggtttttctatatataagatcatgttatctgcaaagagggacattttgactttctcttttctaatttggatgccctttctttcttcctcttgcctaatttctctggctaggacttccagtactgtgttgaatataaatggtaaaattgggcatccttgtgttgttcttgttcttagaggaaaagatggcagttttcccctcttcagtatggtgtttgctgtgggtttgtcatgtatggcctttcttgcgttgagatatgttccttctatacccaatttgctgagaatttttttatcttaaagtaatgctgaattttatcaagtgctttttctgcatctgttgagatgatcagagaggccacttttgaagctcatgttgaaggtcttttacttctgttatttctgctggggatgaagaatactgggtatcaggaagggacagtctagcaaaatgttagccagagtgctggctaaattctgtatttaatttatataaaaacacttcagggaattatgttaatatttccagtgtaaaaccaaaattttacatacaaaaaagtcctgtaaaaatgtttctttcttgcaaacgatagtaagagaagaaaaaagaaaattaaaaaaactgtagaccaggtgcagtggctcacatctgtaatcccagcattttgggaggcccaggtgggcagatcacctgaggtcaggagttcgagaccagcctgaccaacacggtgaaatcccatctctactaaaaatacaaaattagctgggcatggtggtgggcacctgtaatcatactactcaggaggctgaggcaggagaattgcttgaacctgggaggtggaggttgtagtgagctgagattgcgccattgcactccagcctgggcgacaagagtgagactccgtctcaaagcaaacgaacaaacaaaaaccccaaaaaactgtaaaaaatgtttatttctcttaaattctctaatgggtaaaatgttgcaaaggctgtcggatttcttttgtttgaagaaataagattgtaaatcctgtcatatttcttttgtttgaatcttaaaatgaacttgataaaattatttccctatactttaatcaatgacttccaaaatcatcattctcagtaaactatcgcaaggacaaaaaaccaaacaccgcatgttctcactcataggtgggaattgaacaatgagaacgcatggacacaggaaggggaacatcacacactggggactgttgtggggtgaggggagaggggagggatagcatcaggagatatacctaatgctaaatgacgagttaatgggtgcagcacaccagcatggcacatgtatacatatgtaactaacctgcacattgtgcacatgtaccctaaaacttaaagtgtaataataataaaataaaaattaatgacatagaaatcagagtaacactgtgcctatgaaatattttgattagtttggaagaaagtccttgtaatattttcttttaacaaaacaaacttttcttgtttgttcagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggtgattgtaggagttttaaaatgtaatttaaaagcttagtatcattttacatttatgtgctaggagttgtagtcagtagtcatggtggttttttcttttctggcttttaatgctgttacttttctcacaattgatcctcttataataataagaaaaaaccctggggtttagtgtttagtggggtttagagagaagctttgactagttttttttttttttttttttttttaaaccctcctgacgtgtgctttttttgtcggactaaaggaagcacagcgtgtgggttcagagaactggtgccagccttggactccctggctggctgttagagccggtgctgcccgcctgcttggagaggagggctggccagggtgtctccttgttcagggactccacttgtgtttccccagcctctggttgtgtggtctcaggtctacctgtgcaactgggttggtctgctgcaattgaaataatagtattttcactaaattgtcaatgattccttttttgttgtccaaaggctttcttaaccatatatatcaaggaatgttagtgaaattgttgaagagaatgagttacatcccagaaaaataccttctttaaggcactttttcttaactgaatcataaagacattatgaatgagatgtcttttttttttcctttaaagaatgagctgacttttgagttttaaaaattcatgttaagtgttatcttgcttattggtaacacttcctatattttgtgcacgcaggcagaacttcacgggccttttaacccttatgaactaaagtgccatagtttgaccagaatatccaaattcaggtatgattaacttaagttttccatgaattttttttctctgcttttctgtttatagatctcatcagaaaataatgtatctttatatctaaactgttggaatgtgttatcttttcttttcttttcttttctttttttttgagacagagtctcattctgtcattcaggctggagtgcagtggcgcaatcttggctcactgcaacctccgcctcccagattcaagcaattctcctgcctcagcctcctgagtagctgggattacaggcacgtgccaccacacctggctaatttttgtatttttagtacagacggggtttcaccacgttggtcaggctggtctcaaactcctgaccctgtgatccacctgcctcggcctcccaaagtgctgggattacaggcgtgagccaccatgcccggccggaatgttatcttttctaacttctcatttctctcccagctcctgatttgaggtagtctctctctcacacacgtgaaagccattctatgtaagacatttttgagtatcttttatcaaagactacatttttttctgttcttgttacaattgttattcagcaaagctgtgagagcccactgtatgccaggagcagtgtgtggtttggggcaaactgtagtgaacaagaaacagttgtttgtcttcatgaaaattatggatgcagttggcgggtggggggcatagaggaagccggtaactacaatatagggtgatagggctcttgataagggcacagaacatcatgaaagcatctagggggcccagccacccttgaaagatcatggagcttttccagagaaatctgaggcctggcggatacagaggcgtcagccaaggtgcaggtgttggaggaagagaggggaggtgggatgagggtggctccactggcaagtgcataggcctgagtttgagagtttgcacgtgtaactcgagtaagtttagtaagattggagaattgggtggggggaagggaggtgccaagcttgtggtagacgagggcaaactttgtagacttcattctgaaagggccgtgaaccttactatgtgcattttaaaatgatgcctttgggtaagtcttgtcttctcaaaatgtcttccggggagcacattggaaatgcagatgcccaggtcccctagggccttccaaatgagcctgcattttcacaaggcctctggcgatctgcctgtgcttacagtctcaggagccccagtgtgaagccggcattggatttcagagtagaaagatcctcaggcagtattgtgcttctgaggctggtccctgctgtaacccagggtgggaatatgggaaactgagtccctggcaggagatacagaaacagcttcaccagcactttcacctgctggaagcagcaggatggagctgcattagagtcagtgctgaagggaagaggaagaattaagggtgcccttgctggggctgcagcaggcttctgctgaggggtgacagaggaactgtggggtggaccacactcagttccctctgccaggatgcaggtgatggcccttatgagttgacagtgcaggacagagggtctcgagtggaggtggaggttcgggcatccccagcgtgtgcgtggttcctaagccaaggagtggtcgggatcatgcacgagggagtggagagagaagagggctgaggaccagcttgaggactcctgtgtgaagaggtggtccagtaaaaggagatgtgcaggagagtggggggttaaatatttcttcccgtctatcattgcagttgcccgtttgtatttttgaaatgggttgcttgtgggttggcatagcacattgcctggttagtggatcagtcaccccatctcctggtgctcctgccttttaggtgtgtttggattgagaaggagagcatcaactctgtcattatcagtgacgcccctgaagaccttcaccagagaatgctggttgcagcttccctttccatcaatgcgactggtaatttaaagatcctgtttattccttgtcctctcttttttcttttccttgacttcagctactaggaacaacttatcctataattggtgaacaagtctacactatgtactattctttttttttctttttttttttttttgagacagagtcttgctctgtcgcccaggctagagtgcagtggcgcgatctcggctcactgcaagctccacctcctgggttcacaccattctcctgcctcagcctcccgagtagctgggactacaagcacctgccaccatgcctggctaattttttgtatttttagtagagatggggtttcactgtgttagccaggatagtcttgatctcctgacctcgtgatccacccgccttggcctcccaaagtactgggattacaggcgtgagccaccgcgcccagcttacgtgctgttcttttaggccattttctgactgctttggctggtgcgaggttacgcggtggagcattctcacttttccttttatacaaggatgtgggaagtattaataattgactcctggatctttcattcattccaccctgcttggctacagagtagaatacatccaagctcttggccctgggaaaaatccaatagcctgattaggggaaagagatgcaaagagtaaccaaataggagttatccccaagtggggtaaaagcttacgcatcatagcgtagtgtctctctgtagggtactgtggaaacagagaacagggagtgtgcgttactattggggtgggcctgtggggactggacagactcagcagaggaggggatacctgcagatgagtaggagcgggccgggagggaacgctgccctgagcagcgtgagttaatgcccgatgttgatttagcatgacttgaacaggatctacgatgctgctgagagaaacctctctgatgcctcatatccctggcctcccggctctcctcagcatgttattcgcaccggtgatagagttaaggtacgggcatccctcttgtctataggctttgtaaaataagaacctgggcgggaaaaaacgggtgcctctccttgctccttttggaaagaaagcctttatggaagctagccatggcacgtctcgctgcttggggtgaagcctgtattgttattgatttatttatgcttgggctgattttgaaagaagctcagaaagcttgtaaaggtacacactgtgtcacataggagcttgaggcaaaaaaggggtaaaataaattaaaaatggagctaggaatgaggctcaaaataaatgtcatggtgatggacatcccattgttaatgggtggtgaatgtgattccaagttttctggtgaccagttgtcgacaagaacccgtcagtcccccttcttgtggtaaccatgacatcagaaggcagattgcccagcagattgtagctcttgttaatgccacgattaagccaggatttctcccagagactttgatagagaggagtgtgtgatgccatgagcagagctcttaaaggcaccctcacagtgggggctgctgccgtgtaaggttttgtttgcagactagggattgacagagcattctctgtggggaaagcactaacataggttttagtggagcagtgggtgggggtggctagaaaaggagtaatatttgggctttaggaactcacattctgctgggcaggatggaaatggccatgacgagattgcagtagaggcctggtagcacttcaagagtcgggggcatggaaagttacccttttcttcttttctagtcagctggtgagcatggaggggtggtccatagacctagagggctaagttcagtcaaggcaggtggaagggccccaccgtttactcagtcctttttgccattacacttgttcagaatctgacagtgcaatctcaaaatgtgtagtgcttttttttttagttgtaagaatatttttttcattaaaatatgtgctacttagaaaaagctgaatgggaaaaattaacacatttttaaatttatagatttaaatttaaatagtatacttattttaaatttgtatatacatatttttatttaagattcttgttatactgtattcttttcccacaaataccaggtttttcatattatgatatctttgtaaatatccattttgataattgtatcatatatcactgaatgggcatatgatggcttacaaaaataccgccctgttttaattatacatgcacttgtttctgagcggctcttgtctgaaaggattgaatatgcctttaattgttgaaatgtgacctaattttgcaatgatgatgcagtaaatccctctgtaagttcaggcgtcttggagcctcggtggggagacagatgtgcaggaaccacacgtggcagtgggatgatctcatgagcaaatagcacgctgtgcacctgcaggcctgaggcttggctagtgcagaagcaggtcccttcctctcatggcactttggacgccctgcttgcctttttaactagacaaagctcctgcttcacctcttttaaacaccagcttttgaggatttgaatgatatagtgtgttattttcacaactccagagtgcaagcgtttaggttgtagacattcaagaaatactgacatacttggtatttaaaacaccatctttctagaaaaagcacaagcttaataggaaaaggttatatataacaatacacagtgctttgctgattatattcattttgttgaattaactgaaatgtgccagatttgggacggtttatgtgacagtgtgcgtaagactagttgtctttgaatccacaggcttaactaggtgattatcggaaaggtagcaggggggcctggttgattttcctccaaactctgcctgcctctgagtagttgtataagcttggttttgttgttgttttttattttgttgttgttttttgagacagggtctcactctgtctctaaggttggagttttttttttttaatttgttgagtgagtaacaactgtttttgagaaactttgaaagatgacagctgtttgatttgggatgagcattctcctttcctttcactttaaatatgcagtcttctgcagcgagcaggaggggggtcttcagtacagaactggcccaggggtcccagcactgtgtcttaggtgtgttccggaggggagctgtcctccaaagcccacagctcctgcgagccgctgccccgccatgcgcccatgcccgtttgcttccttttgtgagccacctctctaatgcgcacccgcatgggactcgtctcctgttcgggtggcgtctggctgctgcactagaggctgtcctggccccccttgttaaacgcgaagcttgcagtctctgggtaaagtctgttctccctccacatgtgtcactgtcctgtcacaactgattcaactttacgactaagtgataattttttaccacctctaacatactctttgtacaatagtggcaggaaaggaagatgagcagaaaacttaattttatcttgattttcaatttaaaaaggggaaggagatatgtgttatgccccattcataagcagagacatctaagtggaggccactgtccccttctttgccaactggctgtggactgacctagctgccatttgtctcctctcctttgttctttctgccatgtgaccttcacttgtagttggcccctccataactcagggtgactgagccttggtgccagctttcctcttcccttcatcgtggagctgatccaccacacatctgtccccggagtgcgtcactcctcttgctgcccctgtcctcgaggtgttttccctgaacagttggagtagttgatggtgtcagcctggattcagtggcatcatcattgtgtaccttgtggagcccgcctccctgggtgagcagaatgctccatggtagcagagcctggcacctccaggatgggagcagacatctgagaacacgctcttattggtgtagtgacaagaacactgtactcacctccttcccttggttcttggagccaggttttgctactggggagactgccaaatgctggccatggtttagaggctaagtcacgtgttgagggcagtgctgtaaccctgggaagatggtgcttctgaacaggcatgagagggtggggggatctttaaacaacaacaacaagaagttctatcaattaaaacctaaaaattaatatctacacttatatgtacccacaaaaattaaacaaacaaaaaattgaatgagggtggattaaaagaagactctcactgtttaactgggttttctggctactgtggctaaaaacaagctaccccaaaacttcagtgggctacagcaaccttctttgcctctgtgggtgaggaactatgtcagggtacacagggatggcttgttgtgttcccaatgttggggcctccagctgaaggatttggaggctggtgggtgtccaggctcacatctggtggttgctgcttgccagagacctcagttgctctcagtgaggacttccacaagtgatctgtctgtaggctagtttgggtgtcctcagcatggtgggttggtgctgagggtcctgagaatgagccaggtggcagctgtccctgtttttttgtttgtttttttgagttggagtctcactctgtcacccagcctggagtgcagtggtgccatctcagctcactgcaacctctgcctccaagtgatcctcccacttctgcctcccaggtagctgagattacaggtgtgcaccaccacacctggctaatttttgtatttttagtagagaaggggtttcgccctgttggccaggcttgtctcaaactcttggcctcaagtgatctgcccacttcagcctcccaaagtgctgggattacaggcgtgagccaccgtgcccagtatattagttcattctcacactgctaataaagacatacccgagactgggtaaattataaaggaaagaggtttaattgactcacagttctgcacgactagggaggcttcaggaaacttacagtcatggtggaagggaaagcaaacacgttcttcttcacatggtggcagcaaggagaagtgccgagcaaaagggggaaaagaaaagccccttacgaaaccatgagatttcatgagaattcactcaccatcacgagaacagcatgaggttaaccaccctcatgattaactgccttccagagggtccctcccatgacacgtggggattatttaggatgagatttgggtggagacacaaagcttaaccatatcacctggcctgtgtcaccttttgtaatctagctgcagaagccacacagcgtgagttttactgtagtcacagtcacagctagaccactgtggcttctaggtcccactgtaattcacagtgtggttggaaactactgagacgccttaggcaagggagtaacattgtatttgttttgaaaagctactcctgtgtgctatatggagaaaagattggaagaggcaggagtaagagatggggaattggtcggaaagttgttaccaagtccaggtgagaaatggcagtggcttggaccaggctgttggccgcagccatggagaggctattagggagtgataaaggtgacaggacgtgccagtggtcagaggagggtggtgataaaactgggatacaaaactttgtaagtgtgcaccattgttttaggatgagaaggtggaacatttttttaggcttttactaagtgctagacttgtttgacaggtcataaatatgtacatagccctttctccagaaatctccctaataagaatttaacccatggaaagaattcgaaggcaagggaaaaaaaaacccattcatgataaaatattcttttcattatcttatctaccacattagaaacttaataaagtattaatacaaattattaagtattaataaaaatactgaatttactattcttataactatattttataactatattttgattgtgaaaactggcagaaaaatgcacaagtgaaattaattgctgtactagggctggcagaatttaggataattttatcggtcaatttttacatgctaaaacatatactttaacaattctgaaataatggactcttctgaaaacattccatttaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggtaagggtagtgcagcatcacggcaccacaaccctgtctctctctggttttgcttacctgacagtgagtgcagggtctgctgtggagctcgcggtgcagacacacacctctggtcctggagatgtgcacgttccttgtccctcctggagtcaccctccaggaggaccgctccttaacttgccagtttgatgtatctttcctgtgaaaagtaacttcctgatggtgctctctgagtctctcatttggtgtctcctggcataagcttttctgggcaatcagctaaaccacggggctgtagggctgctgtgggtctcattccaagtcaggaagtggaacatccttgctagttcttactgggaaaggaggacacaaggtcctgcccctctgcccttctcccggcctggtgaccatgctgagcagagggctgggtcagcgtgagtgcagagctgagctgcttgcagcattgtctgggcaccgcactagctctggggtgaggtggcaaggcagacagggaaactgtgtagcaagtacacaaagtatttgtatgtcatttgaatctaataatagaaatgtgggctcgtatttgtgtacattaaaaaagatctttcatcgttatagtaatttatttttattgcattttacaaagtgggaagaccaaaactgatcctttaccacaaatagtttgagaaatgctactttctaagtactcagtcgcctttctttcttagaagttccatgagacgggtgaggttaacataaccacactgaagggccgggggaaaggaggagctgcagagacagctgccgatgctccgggggcaggtatcagtgttgtctctgcaactgttaagtcataattgcctggtcacaagaaggggcttatgggcttgaaaatactccttaagccatagacctaatgggaaaatgtaaaactattaaagtgctacaagcaaattcaggaaatctgtgtgactttgggtgtggcatgagtttataaatacaacacccaaagcacaatctgtgaaggggaaattgatacgtttgaatttatcaaaattaaaaacttttgttccgcaaaagaccctcttcagaggaagaaaagacaaagtgcacaccaggagaaaatagttacaggttacatatctgatgaaggacttgtatccacaatatgtaaggcactcttaaaactcaattataagaaaacaagcaacagaattaaaatacggatgacagtaaacccatgaaaagatgctcagcatcatatgtcattaggaaaatgcaaattgagacttccatgagatagcaccacctacttactggaatggctgaaatccaaaacctgacagtaaccagcaatggcaaggaggtggtgcagggggaccggggaccttttgttcattgctggtgggaatgcagattagtaccactattttagaagacagtttcatatgaagttaagcctgcatctaccatatgacccaggaatcccatctgtaggtatttattcaagagatttgaaaactagcatccacatagagcttgtatgtgaatatcaattgcagcttgagtcataattgctaaaaactgggagcagtcaagatgccttcagcaggcgagtggataaaccatactgatgacagagaatactaactctgaatgctatgaattctctaacgggatgaaattcagttacgacggagccttatgagtgtttatgttgctgttcatttacaggttaatattctcagggctgctattaacaagctagtctgtgatggaccaaatggatgcaagtgtcttgggccagagagagttgcgcagcttcaagacattgcccgtcagaagcttttagggtaagctgtgtgatgacgcgggcttcttttcttcccagtcaactttctcagctgccttgatcatggctgttttgaattgtgtaggcaatgtgacatattgatcacctgaagtggagtgccagtgctggaggcagcactgggaggcatcagaatgtaggcacgcccttcctgtggagagcagcacccttgtcctgtgtgtgtgtgtcccttgaagggacagcgtgggcagggcatgggaagccacagtgggtaatgtgtcacccaccattcctagtggtgggtgtcttagggattgggggagtccggcttgtaggattgggccttacagagctgggcctctcttgaacctctctgcaggggaggttggagaaggagcattctgacctgacttccctgtttctcacctcctgctggactctccatgggacaaaccaaaccagaatgcagacacaaaaggctcctgttggtgtagcccatgagcccaaggcagcttgagggccccgggaaggccaagaagagtgggagtggtcatggaggagaaaccagcattccacctacccagtcctgtgctcctgccccagagccagtctccctgggaagggcccggtccttccttgcctgacagtgtcctgtgctggctgggacctggacctctgtgaaagcaggtggcatctggtatcacggtgacacttctctccttcctatgccttttgggttggtttcttttagtttaataagcattttttaaaaagctatatatagctgtcttagaaatggtgagaaaggccagttttagttttctctcttcattttcttttatataaaaatatttttaatatttatttatttatttttagagacagagtctcaccctcttgctcaagctgagtgcagtggtgcgagcatggttcactgcagctccaactccttggcacacatgatcttcccacctcagcctccctagtagcaggggctacaggtgtgcaccaccacacctggctaatttttaaattttttacatagatgaggtcttgctatgttgcccaagctggtaattttttttttttttttgagaatggagtcttgctctgtcacccaggctggagtgcgatggcacgattgcagctcactgcaacctccacctcccgggttcaagcgattctcctgcctcagcatccaagtagctgggattacaggcacccaccaccatgcccagctaatttttatatttttagtagagacaggatttcaccatgttggtcaggtgaactcctgacctcaggcgatccacccgcttcagcctcccaaagtgctgggattacaggtgtgagccaccatgcctggccagtaaaaatatttttatgtaaaatgtgggttgaagtttaagtacacaggtatatgcccatgtggccagcaccgaggtcagagccccggtgctccttagggtgtgcgggtgtggttgtagccaccatcactccctgcccccaaaacaagggtaactgtatcctgccttattatgccataggtagtaggtattggtttgtttgttttaacaattcaataactctagtgaatttatagttgtgcagtctgtcaacacaacctagctcttcagcatttctgtcatccagagaagtttactcataagtattgtcgggaaaggcagtctcatgcaggcagcctttgatcccctctctgctgtctgagaacaggccttgggcctgaaacgcttccttcccataagattaagggtcctcacagcctgtggggggctcgtcgccatgtgtgggaagatctttccttgattccggctctgccctgcttaagcctgtgtgtcatacggtacctggtcaatcccaccactgcagggatgggacagggctctcctgctgccacataagagaggggcctgcaggcctgccttgtcttccgggaggtacccgctggccacagggaccgctgccagtcactagagctgatcctgtcctgttgcctccctctgtaagtaaaggttcgttccagccagggtctgactgtgtgttttccttggcgactccaagacaagatgcaggggtgccctgacttctcctggcagcaggcagcagatgccacctgcttgactaatatattaaaacagaatgtgtcattgtttgtacaaccccataaatttactaaaactaatcaattatgttcctaaagttgatgacttttaggatatgtaaagtacacctcagtaaagctgtgttgaggatcgaaagttccccctgtccatttacacgcagtcttgttcccaccccagcccaggtaccactgatctgctttctgtttatatatttgccttctctgacatttttatatatgtggaatcacattttaattttaaaatctggcttctttcacttagcttagtacttttgaggtttatccatactgtatcatgttcctttttactaaataatatttcattgtttgttatgccacttttttaatccattcaccagttgataaaatatttggattatttccagtatttggccattatgaagaaagctgctatgaatagtcacatacagtctttttgtgaacatgtatttttctctcgggaagatatctatgagtggagttggtaggttgtattggtaggtttatgttaatcttttaagaaaaggccagggccagacgtattggcttacgcctgtaatcccagcacttcgggaggctgaggtgggcagatcacctgaggtcaggagttccagaccagcctggccaacatggtaaaaccctgtctctactaaaaacacaaaaattagtagggcatggtgacacacgcctgtaatcccagctacttgagaggctgaggcaggagaattgcttgaacccaggaggcggaggttgcagtgagccaagatcacgccattgcactccagcctgggtgacaacagcgaaactctatcaggaaaaaaaaaaaaaaggaaatagccaaactgttttccaaaatagctgtacaatgttacatttctaccagcaacataggctggctctggcttctccacattctcaccagcacgaggcaccggcacgtgttgttactgcagtcagtctggtgagtatggtagtatctcattgtagcattaattttcgtttccttaatgactaatgatgtagagcaactttttatattcctcttagccagtcatttatccttttttttttttttttggtgaaatgtctgttcagatcttttgcccatttttaaatttgtcttttcattattgagttgtagaaattgtttttaaattttagatacacgtcttttattggttaagtaatttgcgattagtttcaccattgtgtagcttgtcttcttattttaatgatgtcttccaaagaacacaaatttttaattttgatgaaatctacttgctgtggtttgaatgtgatatgtttgaaacctaatacccaatgcaacagtgttggaaggctgggcataataaggggttgactggactcatgtcatcattgtgagagagggttagttatcaagagagtatggattgttgtaaagtgggtctgccccggtgcctcttcctgtctcaagtactcacttgcccctctgccatgtcatgatgcagcaagaaggccctggccaggtgctagagccatgctcccgcacttcccagctccagaactgtgagaaatcaagttcttatctttgtaagtgacccactctctggtcttcagttataacaggggaaaatggactaagacactactttatcttttttttgagacggagtcttgctctgtcgcccaggctggagtacagtggtgcagtctcgactcactgcagcctccacctcctgggttcaagcgattctcctgcctcagcctcccgagtagctgggattacaggcacacgccaccaagcccagctgatttttgtatttttagtagagatggggtttcaccatgttggccagaatgatctcgatctcttgacgtcgtgatctgcccgcctcagcctctcaaagtgctgggattacaggggtgagccaccgcgcctggcctactttatctttttaaaaaatgaattatgttttcggtgctatatcttaaaaaatccttgttaaactgaaggtcacaatcattttctctctttttgtaattttttatgtttaggtttttgatccattttgagatgattttgtatgtggtatgtgatacaagagcctaaagtcattttttgcatatgaacatctagtggtgatgacatcatttactgaaaagctatacttttaccattgaattgccttggtaccttggtcaaaaatgaattggccataaatgtaaagatttattactgggttttctgttttgttcaattactttatatctatctttgtaccagtgctatactgtcttaattgctgtagcattagtcctcctgttttattctttttctttttctttttttttgagacagagtcttgctctgttgcccaggctggagtgcagtggcgtgatctcggctcactgcaagctccgccccccgggttcatgccattctcctgcctcagcctcctgagtagctgggactacaggtgcccgccaccacacctggctaatttttttgtatttttagtagagacggggtttcactgtgttcgccaggatggtctcgatctcctgactttgtgatccgcccacctcggcctcccaaagtgctgggattacaggcgtgagccaccgcacctggcctgctctttttcaaaattatttttactcttttatattcttttcctttccatgcaaatttttggatcagcttgtcagtttgtataaaaatccttgttggaattgtggtagggattgtgtggaacctgtgagtcagtttggggagaattgccatcctaacagtagtgagccatccagtccatgaagatggagtgtctgttcatttgggtattctctaatttctcttaatactgttttagaattttcagtgtgcaggtcttgcactttagttgtttctaaatattttagttcttttaatgctattgtgaataaaattgttttcttaattttgtttttgaattttttttagaaaggaacagttgatttttatatattggtcttttatcctgtgaccttgttaaacttctgtattctagtagttgtttgtagattccttaggatttcctacatacaagatcattattattatgaaagctttctttctctagtaatgcttcttgttttaaggcctattttgtctgatattaatatagctaccccagctctctttagctaccatttgtgagctttttctatccttttacttacagtatatttgcagttttgaattttttcaaatatttttttctgcctcgtgcccgctctcttctcccctagggagacattgctttgcacgtctgtcagtgcgctggtgttaaacgcgtgctgacacggtcgatacggcctcactggtctttgaggctctggtcactcttcttcagtctctttcctttttgtgcttcagattggttaatttctgttgatctgtcctaaggttactgatcctttattatttcatctcaggtcgacgtggatgcggtacagagaattttccatttcagtcattgtacttttcagctctaggatttctgttgtttctttggtagtttttaatttttattgagattatccctgattcattgttatcctatttttaaaaaacttcttggcacctgttcacagtggctgccttgaggtctttgagtgctgaacccacagctggccacacactcagcctctactggctgctcttctgtgtgtgggccacacattcctgtgtctttgatgtctcctaatttttttgttggaaattgggtactttagataatgtactggagcagttcccccagagctgctgtttttgggttttgtggttttgtttgtttcactttagaaaagtgcctagtcttaacctgtaagtccatcccctgtgatgtgaggtcactgatgtctgggttctgctgttttgttatgtttttaattttaatttttatagaaacaaggtctcactttgttgcctaagctggagtgcagtgatgtgatcatagctcactgcagccttgaactcctgggctctggcgatcctcctgcctcagtctcccaagtaggtagggctacaggcatatgtgaccacgcccagctcgttttgttttctttattcttatttttattttttagcctggcttcctaggtgttgtccttgtatctgatctgcacagcttagtgcttagccagtgatcaatcaaaagttgtctttaaatactgccctgaaggcttctgccctttgccattggagctaagtatgggttgaaaagtgcactccaagttcaggcactttttgattcttccctggcctctatttttctcagggcttcccaggtttttcccacgtgtgtgcacccctccatcagtcagggatgtgtggagggcctgctccccctctgtggcactctcctttccagagtctcccttttacctcctgaatagtctggtctgctgctggccccaagcaggatgtggcgtgaggctggaaagctatgggctttccccatctgtttccttcattgctgtttttactgacaatgctccaagtcaaggtgtgaggatttttccccctctgatccagatcacatagcctttatggccctgggagtgctgtggtgctgggttcaggggcaggtgtatggggtgggagcggctccctaccccagcaagaactccacatactccactgttctcacctggagctggcagtttgtcatgaatgaatgcttctcaacttgttgtttgcctttgcctttggttaatttccagagccttcaaatggttgttgttggtatgtatgtatgtatgtatgtatgtgtgtgtgtgtgtgtgtgtgtgtgtatgtatgtatgtatgtatacagttttgccttgttttatagttttttagtggggagaggctctgcagaactctttactccctcattgttcaaattccctatctttttaagctgatgatatttccaacttgtcatgattgcttgagagctaatggtacaaaatgtcctgttacatttcagagaacttgactcattcatgtggtgtgcagtgctggttgctaagggaacatagagacaagactaggtcttacagatctgtcacactccatttctttctgcttttgaatatgccatagattaaaatattttctgatcataactgcataaatgttgacctttaaacagtttattctagttccaattctgtgggaagcatataggatttaaatctttaaaaaaatcacagcagtgttttcagttactaatatataattaagataatttcttttttttttaaattagtttgttctgtcagtcaaaaccaagggagaagattgttcccaagtggcatgaaaagccctacgagtggaatcaggtgagtgggacgcaggctgctacatgagcagaggccacgtggaggaggggacaggccctgggcagacccagggttcagagccagggctggccgagggtctgagaggcagagacaggaggcaaagtggatggctttgggggccagctggcaaatgtctcagaccagacaggctgtttctgcacagtgtcttctatgtgatgtcccggcaaagagtcagacaccaggataactcactgcctgtgagttgggaaaaaaaggtatgagggtctggattgaaccttcctgctcttgttggtctttgtgaaatgcaccttggctgttccttccatgtggctggcttggtggctttcgggctgtactggttgttgtctttgtctgcttgagctgctgtcacagtgccaccacgggtaggggcttaggaacagcagacatttgttctcacagctctggaggctggaagtcctagggaaggtgccagtttgtgggtccttgtgaggacctctgagggacatctgcagatggccaccttctcactgtgccctcacgtgaaagagagacgtcctctcttagggcacaaatcccatccttggggtcccacccttgtgacctcatctaacccttatcacctcccagaggccccatctccaaataacatcacagtgggggttcgggcttcagtgaaggaattttcaggggccacagttgagtcatgaagaaggacaaagcccttcataggctccctggtacttcctgtctgtagggctagaaatggaataaaatgtgatttcagagaaaggagcccaaaggagtttggagatttaattccagagccagggatatctctagatacaaagcagcaggggcagtcttcccctcccctttgacgatctaagtgaggctctgccttggaggactgtgtcccatcctgcgcctcaaggttgctcctgctgtgaggctcgcctgctccccctgtgccctgtgcctaggtccctctttagagaccccaaggctgatcctggcagccggccccattgtgtgcagagctccatgggcaaggagaggggcggccacaccagcccccatggccatcaggctcggttggagtgtctgagggtgacgaactagcaggactttgtttgaaaacagaatttcactttgaggttagtatgttttagaaaatttcagtgtcttcaagacctgtaatgcaattaccatccacatttacataggcatgcatgggagatttctcagtaaagcttgccatagtattaatcatgaatttatttatttgcagcttttattttagattcaaggggtacatgtgcagcttttgttacttgggtaggtggcataatgctgaggtttgaggtacaattaatcccatcacccaggtactaagcatagtacccaataggtagcttttcaatccttgcctccctcccccatctagtggtccccggtgtttcttgttcccatcttatgtccatgagtactcaatgtttagctccacttttaggtgagaacaggcagtatttggttttctgttccagcatcaattcgcttaaggtaatggcctccagctgcatcccgattgcacaatttcattctttttaatggctgtgtagtattccatggtatgtgtgtaccacatcttctctatccagtccactgttgatggccacctgggttgattccatgtctttgctattgtgaatagtgctgtggtgaatatgtaaatgcatgtgtctttttggtagaacaatttgttttcttttggacatatactcaagtaatggaattgctggatcaaatggtagttccgttttaagacctttgagaaatctccaaactgctttccacagtggctgaactaagttgtattcccaccaatggtgtataagcattctcttttctctgcagccttgccaacatctgttgtttttttgactttttaataatagctattctgactggtgtgagatggtattttgtggttttgatttgcacttctctgatgattactgatgtgtggagcatttttaaatgtttttggcccttcagtgtcttcttttgagaagcgttcatgtcttttgtccatctttaatggggttatttaaacatgaaattaaaaatgaattatcaaacctatagtatgaagtgtgagagtagagaagtgttctgtaaatatttttggagaactgaattatactttgtgcatcctggatgttaatgcatgtgtattttatgtctggaaaagccctgtcacagagcctgactggtccgcttgtctaccccattaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 1268 - DNA, 118467 bp, Homo sapiens
cgtcacttccggcagccggaggcagcagaggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaacgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatattctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtggccctgagtaagtagaacagtgatgtacctttctccacctgagatagattagaaaattatataaagagtgagtaatagaaactcttagactaggtgagtcagggaactaatttccttatagtccttttaaagaaaccttatttatttgtttatttatttatttatttacttatttattttttgagacagaccgagactgtctcccaggctggagtgcagtggtgcgatcttggctcactgcagcctccacctcccaggctgaagtgattatcatgcctcagcctcccgagtagctgggattactggcgtgcaccaccacgcccggctaatttttgtatttttagtagagacagggtttcaccatgttggccaggctggtctagaactcctggcctcatgtgatccacccgcctcggctccccaaagtgctgagattacaggcatgagccagtgtgcccaactgattagttttgatcattgatcttcactcagagaagcaaaaccttacattgaaccagagtaggagctccatgctttctaaactgaagccaaaaacagtcatagcagatttgtgataatgaaggatttcaaatgggtcttttttctttctttcttttttgagatggagtctggctctgtctcccaggctggagtgccgtggcatgatctcggctcactgcaacctccgcctcccgggttcaagtgattctcctgcctcagcctcctgagtagccaggattacaggcatgtgccaccactcccggctaattttgtatttttagtagagacggggtttctccatgttggtcgtgctggtctcaaactcccgacttcaggtgatcctcccgcgtcagcctcccaaagtgctgggattacaggcgtgagccaccacgcccagccatgtagtgtatttaaaatgaatttttgactttttttaaaaatcaagtttatcacacatcgttgcattaatttaccatgccctgttacatttttaactcttgcattggcatgttctggaaggagctgtgtagctttcacagtgtggagcccttgtgtcagtgttataactcaggtatagtccatattaattacctacattactgcactgctaagtattagacttcctgccaattgagtggtgaatgtacaagaatgaatgggagctctcattctgttgagaaccttttttcttaaagttaggtttgttgagatgtaatgttcatctgttttaagtatacagtttggtgaattttgacaagcgtatagttatgtaaccgctatcacaatcaagatgtagaacacttccattgccagaaaggtcccttatggccctgtatagtcagtgccctctccctttcttagcccctgggtaaccactgatctgctttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttaaattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgagattgggccaccacattccagcctgggcgacagagccagactccatctcaaaaaaaaaaaaaaattagccaggtgcggtggtgcatgcctgtaattccagctactcaggaggctgacgtgggagaatcacttgaacacaagaggtgaaggttgcagtgagccgatatcatgccactgcactgcagcctgagtgacagagtaagactctgtctccaaaaaaaaaaaaaaaaaaaagcagacaacttgcaacattatcttcatccttgtacactaatttgtttttgtttgtttgatttccaaatattaatgtccacccttagtgaatgggtatataaaagtttactgttggccaggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggccgggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggctgctagtaatgacagaagaccactaactatttagtagcaaagcctctactgggccccagatctctagcttaggctccacaaggagatgtagttgtacctgtacatagagtatttctaaaacttttttttaagcttgtagatcaggggtgtccaatcttttggcttccccgggccacattggaagaattgtcttgggccacagataaaatacactaacactaacaatagctgataagctttaaaaaaactgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcgtagagatgagatctccctgtattgcccaaggtggtctctaactcctgggctcaagcaggcctcctgtcccagcctcccaaagcactggaattacaggtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacgtaggacagccttccacagcaaagaattacccggcctaaaatgtcagtagtgccagcgttgagaaaccctggtatgtacttagccccccatgtactcaacagcgcagctcagtggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgctttttttttttttttaattgagatggagtcttgctctgtcgcccaggttggagtgcagtggtgcaatctcggctcactgccaacctctgccgcccgggttcaagcgattgtcgtgcgcagcctcccgagtagctgggattacaggctcccgccaccatgcctggctattttttttttttttttttttttttttttagtagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactagtctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccctcctcggcctcccaaagtgctggaattacaggcgtgagccactgtgccccggcttaatcagcttgtcaacttctaagcacaacctgttgaatcaagctgtttgggccttatcagaaaaaagttggcctatagtttcagctactcaggaggctaaggccagaggatcacttgaggccaggagttccagtcgacctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactatttgattgcaaagaggattgttctgcattttattactttttttttttttttgagacagagtttcactcttgttgccaggctggagtgcaatctcgtgaccttggctcactgcaacctccgcctgccagcctaagtagctggggttacaggcacacaccaccatgcccagctaattttttgtatttttagtagggatggggtttcaccatgttagccaggctggtctcaaactcctcaccttgggttatccgcctgccttggcctcccaaagtgctgggattacaggcttgagccactgcgctcggcctgcattttattattctaagatatagccaaattttatgcctggaattttttcctgggctggaacaaattcctagtaagagtcagggaatattccgtgacttgtggctttggttaaaaaagaaaaaggagtcagggaatgcagtaccctctgatcaccactgggaggactaaagcagaaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttagagttatagactggaatttgaaactagtcttgagatttaactgtggacaaattcactcggctgtgcctcatggtttttttttttttaaatcaaaagagaataacatcattcaagttgtgtcttggtttttttgtttgtttacttagatttttatgacttcactttctcaatttcctctgtggccagattcatcaggcattcagtcactttcatctctgtcaggctggccttgtgttctgtctgtctgttctgctgcatagttgtcatcctgagatctcccttcacccatatcctagggattccctttgcctttcctgttcgatccattttcttccccttggttcactcccaggtttcattgcagcagttcctccagtgattttctgagaaagttgctcagaggtaaatttttaaaatcctttcatatctgcaaacatctttattctgttctcatacttgattgatattttggctgcatatagaattctagactgaatgccctttttcctcagaattttgttttctgtcttatatagcatctgacactccgatttggagagagagaatgctattttgagtcttgcttatttttctgtttgtttaaggctgattggaagttttgtgcatttggatggatcttgaatacaacagtgggacacactgttatttctttgtggtgctcttgataccaatatatttagtcttatcacttggcctaggcaagcacggaatgcccatgttccagggagctgagtcgggagagggcagaaggaaagatctgtggctttctgctttctctgcttgttttcagtgtccctgccctcagttgtgccctgtgtccccaagcccagagactttccattttgccctttctaaagaacctccagttttttgcctgagtgggagaggagacccgggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtgttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttgttgtagtagagtagcgtttccccttttcacccaagctttgttacctcttcttgggtggtgcctggcctgagatgtccttcatctctcataagaactctcctacttgccctttgaggactccatcccttcacatcttggggtaccttttttccttcatctcacccaaatgtgatcatgtcctttgggtgcctagagctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaagatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcattcttgttttttgcgggggttggtgatttttatcaaatcaaggacagacatcccattctaatcctagtttgctataggaattttgtgggggctttttggtagagacagggtcttgctatgtttgcccaggcgggtctcaaacttccgggtttaagcaagcctcttgcctcagcctctgaaggtgctgggattacaagcatgagtcaccatgcctggccaagagtttttaaattataaattgttcaatcttatcaaatcctttttctatgttgaatgaaataattgcctagctgctttcaaaagtgaaacgtgactttgtgaatatttctaaagtacaaaatacttggaggacagccatttattgtcacaacttggctttgtagtttgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaattttttacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattaccaacccctaccccctactacattgccacctagtagactttaactaatgagaactggccagaactaagccagatggctatctctagctgcagagaagtttgggaaaacaagtatttggccaatgtggtctccctaaacacgtgttcaacttcttgaagaaggaaatctcatgtctttggctgtattcagcatttttcagtagcagttacatattctagttttcatggtggatgaagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaagttatcaaagaattatataacattttgtgtgtgtgtgtgtgtgtgtgtgtgtgtgtgtgtgtgtatgcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaacttttaaaaagttaattcttaaattttttaatttaaggacttcgtcaagaaacatcgaattaaatatattgagtttaaccctaacaagcatcagatctttcagtctgctgtatgaggaaatacaagtttctttctgctttctattatgattgttgatttgcatgagcgtgttttaggttaggctgtgttatgctgtggtaatacataccaccaacatcctcatgatttaacacaataaaaaacttctgctcacaccaagtctgcttgagggctcattggctccgtggaaactgatctccatgtccaggccagtttggtcttgtggccgtccgttttagggcagtgcttagggtcaggagagcaaaacacagggctggagagttaagcacaggcaactaaatgcttcagcatgggaatggcattcattttcactcacaggatgtgttcagcttagtcacatggctgtctatgcctaacctcaagggaagggagtgcagtcctccaggaactcagatgtaaaaaagccagtatgatggatatagtattgtctacaaaaaaaagtagcataatagagttagatacaagcaaagtactctaggatcccagtaaggagaagtaagaaattctgatgagatgcagggagagccttagaagggttcatgaagatggtgacagatgatacaaactcagtagaatgagcaggtttttcttagatttgaagagaagaaaggacattcaaactaagggaacaacactgactgagtcagagctagactcaaagctagagtctactggctgatgtcgtgggagaggaagaagagatgagcgggccttgaattcgtttaacattcagcaaaaatgtattgcatgtctaccatgtgttaggcactgtttcaggtttggggaatatctgataatgaacaaaacacaaaaagcctgtccttgtgaaggttacatgctagtggaagaagcgctaaggagttagtattttattataagcacactggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccactgcactccagctgacagagtgagactccatctcaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctgttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcatttttgttagaggaacaatgtttacaagttgcctagatttgcagtgaggtcataaaaagcctgtttaatctaaaatagacatttgcaataaaaacagaaattgttgttgagatgccatattatgtgataactgagtaaaacagacaagagcctatcccctaacctggtatgtgaatgtgaaaatattagagaaataatgaagaagtagatggagactaatgaggaaattctgaaaaggacatcttttgagaaattcagaggtagatggcgcaagttttaaagcttactttcactttaaaacacctgagtttcatttcctttgatttgagtaaattacaaagcagtttattagttaaatcaggcttgttttgatttataggtatatagagaaagacaggacattttcctggacagaaagttggaaaagagaaacgtgtaaagggggtggaaagtggctgtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctctgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccatgttggtcaggctggtctcgaactcctgacctcgtgatccacctgccttggcctcccaaagtgctgggattacaggcatgagccaccgtgcccaacctattttattttcaagacagggccttgccctgtcacccgagctggagtgcagtggctcaatcatggctcactatagcctcaacctcctggggtcaggcagttctcccacctcagcctctcgagtagctgagactacaggcatgcactgccacacccggctaatgtttaaaaaatttttttgtagagacagggttctcaccgtgttgcccaggctggtcttgaactcctgtgttcaagcagtcctcctgcctcaacctcccagagtgttgggattacaggcatgagccaccatgcctcactaattaagctttttcttttttggggggttaggggggtgtcgggggttgggacggagtcttgccctgtagcccaggcctggagtgaagtggcatggtctcggctctctgcaacctccgcctcccaggttcaagcgtttctcttgcctcagcctcctgagtagctgagattacaggcgcacaccaccacgcctggctaattattttttttttttttgtatttttagtagaggtggggtttcaccatgttagtcaggctggtttcaaactcctgacctcaggtgatctgcccgcctcagcctcccaaagtgctgggattataggcatgagccaccacgcccagcctaattaagctttctcaaaagaacatgaaacatatattaggtgtctgggagttttttgttttgtttttgtttttgttttttttctgaggcagagtctcactctgtcacccaggctggagtgcagtggtgcaatctcggctcactgcaagctccgccttctgggttcaagccattctcctgcctcagcctcctgagtagctgggattataggcatgagccaccacgcccagcctaattaagctttctcaaaagaacatgaaacatatattaggtgtttgggagttttttgttttgtttttgtttttgttttttttatgaggcagagtctcactctgtcacccaggctggagtgcagtggtgcaatctcggctcactgcaagctccgccttctgggttcacgccattctcctgcctcagcctcccgagtagctgggactacaggcatccaccactgcacccggctaattttttgtatttttagtagagacggggtttcactgtgttagccaggatggtctcgatctcatctcgtgatccgcctgcctcagcctcccacagtgctgggattacaggcgtgagccaccacgcctggcccatctgggagttcttttgctttcccattactttaaacgttggaaatatcatagagtgtttaaatagtctttacctttaaaaataggtaatgttttgttctttttcagtagcaaatgtctgctaccacagtaaaaattgtctttaacttcaggtatacacttatgtgtatgagctcatgttacttgctaatcaatattattgtcaatatttacagatttatcttcaagaagtttcttaatctctctacttttctcatagcgtatgtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctctttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctgtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaagcttttaaaacaaatgctctccctgtgcgagacccttctgatagatgtgccaagactgtgacacatatggcgtagcattcatgcctgcagcccaccaggcctggggctgcaagagcatgagccctgggtctgtcatctgtcagcatgcatcctctgtttgcagcaatgtgccctgtaaatattttcatttcctgtgtgtgcggagacttggaaaaggttgggaagcactggactgtgctaactggaattttaaaagactgttgccagaaatttgccttttgacaattcattaattttagtgataaaattcttgtggatttttagttaagactccttgttgctgagctgccttatagactgcttttggaatctgtaaacagcttgtgtgggcggagctgtccttgttgtccttgattaaagctttcttgagataaggaacggtgagacctctgagtttcttagttcccaccagttccaggtggctacttgccagcttcctcatgtgggcagagatggtgggccaagagagcgttgagacagacgaacctcttccatttaccttacctgatttacattatctagagtctggcctgtggtgtttacttctagtaggttctttctctagaaatgcttgaatatgactagcagagtggtttaatttaaaaactttctcagtttctcagtttttttaaaactttgaacaagttctcactcgtaagtggagttgaacaatgagaacacatggacacagggaggggaacatcacacaccagggcctgtcggggtgaggggcaaggggagggatagcattaggagaaacacctaatgtagctgatgggtcgatgggcgcagcaaaccaccatggcacatgtatacctgtttaacctgcacgttctgcacatgtatcccagaacttaaagtaaaaaaaaaaaaaaaaaaaaaaaaaaaaaaggaaaaactttgaacaaaatcattttactcttgtggggttttttttgcctattgtagatatgacatataaaatgtaaacattatagaaatatagaaattcattatgtagaaagtaagttccttgaaatttgtctcttcaaagacaatcactttcagcagtttggtgtatattcccagagttttttatatagacattaacttttaaaaaattttaacagaaagggactcatggaacatgatgacagtttttttacttagtaatgtaccttgaccatgtctgggtcttagtactcatagatctgacatattagtctaaaggcagcatagtcttcctggctatggtggtaccatagtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcaatctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagagaaaaccagaagttgctttttcccttttcactacttagatttatgatctttttatatatttttgtcattcataatttctttttgaggcaagttccctggccacccgcagtagctcatgcctgtattcatagtgctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacgaggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccgggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatatgtgtcctgttatttctccagtctgtttatttagtcctatacccatactgtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagaggggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaaatatgccttaatataggcgctggggcttgcccgtggtgctcttgatatataaggcccggacattctgccagttttttctcgagcagtgacaccaagaagttaacagccaggtgaatgttatgcacaagctcatcgtctgtcatcttcacgtggccaacagccacagccaaacataacatgttcatatgaaacttgattgtggacttcgcctcatccactttggccaccgtgttttcatcgtgtgtgagcagggaagggaactttactgcctttgttaggcctatgccgaggattcgtgggatttgctttatcagagactctgaagccaaaaatgcatcatacttcttggccagcttcttgaccagattcttattcttgagtttttttggcacctcagtgtccacttggggggatatccgtggccttggtctcgtcacagtgctgctgttcccccaggacccacacttgggacagggagtggacttaagcctgacggtgcccgagaagcgcttgtccttctgggggtcatagttcttcaagctgatctgcaactccaccatcttcaggaacttggggcactttcactggttcccgtgcaggacttcctgcaccgcctcatccagggtgtcgtgagagactttgctgcttatgggttctcatgccacgctaaccagaaaagagggtttagttggttttataaattattaatagtttgggaggaaattgatattttaatgatgccaagtctttctttcttttttttctttcttttttttttttgagacggaatttcgctcttgttgcccaggctagagtgcagtggcgtgatctcagctcaccacaacctccgcctcctgggttcaagcaattctcccacctcagcctcccgagtagctgggattacaggcatgcaccaccatgcccggctaatttttgtatttttagtagagacgggtttctccatgttggtcagactggtctcaaactcccaacctcaggtgatccacccgcctcggcctcccaaagtgctgggattaccagtgtaagccaccacatccggctaatgccaaatgtttctattcaggaatgtgcatgtgtctcaaatttgttttcaggttttgtaacttttttcatctatgttttatataatgcttgttaaattcatttcaagctattttataatttttgttgctaatgtaaatggaacttttttttcctcaagaaggcaataatcatataacttcttgcatttgggaaacttttgatctctcatttggaatgtcgaaaattaagtttatattgttttttaatagcatgctttttttttttttttgagacagagtctggctctgtcgcccaggctggagtgcagcgcgatctcggctcactgcaagctccaccttttggactcaagcaacctcccacttcagcctccccagtagctgggaccacaagcacacagtaccgcacctggcttattttattttattttattttatttatttattttattttattttatttttggtagagatggagtttcaccatattgcccaggctggtcttgaactcctgagcttaagcagtccgcctgcctcggcctcccaaagtgctgagattacaggcgtgagccaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctgtacaggtttttctgtgaacataagttttaatttctctaggagtgacattactggatcgtgtggtaaagaattaagtgaattgttaactagaaaactgattttatataacagtataatattcctagtagaaagaaacctaaagcctctggtctggtctgtgaattggtgtatttttattacttagtacttttcttttctttctttttttttttttttaaagatggacttttgctcttgttgcccaggctggagtgcaatggctcaatctcagctcaccgcaacctccacctcccaggttcaagcgattcccctgcctcagcctccctagtagctgggattacaggcatgtgccaccatgcccagctaattttgtatttttagtaaagacagagtttctccatgttggtcaggctggtcttgaactcccgacctcagatgatccgcccgccttggcctccccaggtgctgggattacaggcatgagccaccacacccagctacttagtacttttctcagctaagatctttatttttgtcagcgttctcttgccctgtgatgggaacgtgatgtatcttgcctattgaagaactaaaacctctgaagaaaacccagagggttgtgggaagagtggcattgatgatttggggacttaatttgttctgagtcagtataagttaaaggcttattgtgtattatgttgagagttttaactgctatccttggggtaagaacagagatgtagaattatatcgtgaaaagaattttctgaaagaagggagtagggacaatctatatcatgcatttaagtcacaaggatgtcgtgaacataaaagatactcacgaaggccgggcatggtggctcatgcctgtaattccagcactttaggaggccaaggtgggcagatcacaaggtcaagagatcgagacctgaggtcaggagtttgggaccagcctggccaacatggcaaaatcccatctctactaaaaatacaaaaaatagccggggatggtggtgtgcgcctgtagtcccagctactcgggaggctgaggcaggagaatcacttgaacccgggaggcggaggttgcagtgagccaagatcatgccagtacactccagcctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagttcagtttagatgagacttcccacaggatgaccatgaaccaatcagaaatggatatcaaaatgctcattttatatatttttaaaatacatgtaccagttgtgaaattcatctgatttagctcttaaatgaaaatgctacccattatccatattgtcctggaagcatctatcccatatttactatgaatctggggatgttagttgcatctgctgtcttgcttttgaccaacttttcatagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggccccaacttttttaagctctttcttctgttactccaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacacatataatataatgtattagctcaagagagaatcggtgagtataaattagagacagcaaggtagctctttctaggcacagataagtgggatggtagctacagggagacattaggccaaggtattttttagaagatggacaaaatatcaacatatttctctactaatggggataatctcataaaaaggaggaaattggtgctgtcgaagagattttggaataggtgaggggatggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatcgcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccaggagcattgttatacaacaacatcacaatgaaattagtgatataattaggaactaagaacttgaggaggaagactgaccctatgaaggtgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcacttgaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctctttcatatagagactttctctggatgtctggtagcctctggttgtctgtacctaatgtggagccctaagcatctgatcacaagctgtgtttgtatgaataggacatgtttgaccacagagctttcctattgggagttgtctggtgcttttattgaagaccccagatatttgtgtccttagatttctgagagtatccagtttctctagataagaatcttctcttctgcctgggaggaactgatgatcccacccctcagtcacttagtcctcccccgcctgccttttcatctgttgcttcactcctgaaaccacgtttcttcatcctggggtgtgtgaaacttcctgagactttgcataaatgcttatgtttagtcacgagtttgttggtgaagactatgttaacaactttacagaaagtttggagaatagagaagaaaaaccccacaatcctaatattctgaataccatttttgtttttgtatattttccatatacatgttttttcaacatatttttgattataattttgtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggctgggcgcggtggctcacgcctgtaatcccagcactttgggaggctgaggcgggcggatcacgaggtcaggagatcgagaccatcctggctaacatggtgaaaccccgtctctactaaaaatacgaaaacaaaattagctgggcgtggtggcgggcgcctgtagtcccagctaccaggaggctgaggtgggagaatggcgtgaacccgggaggtggagcttgcagtgagccgagattgtaccactgtactccagcctgggtgacagagcgagaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttaagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtcaaaattcctctgctgatcagtgggatggggattgggatcaagattgcttctgtgaatagccactgcctggggaacatagcgagatcctgtctcttaagaaaaagaaacagaaacttttggaaacaagcagacaagggtgaaagaaagccttggtgtaagatataatttatatattccatataagatatagaatacatatgttatataactaaaaagcataaaaacagtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagcctggagtgcagtggtgcaatcttggctcactgcagctctctacctcctgggcccaagcagtccttccacctcagcctcctgagtagctgggaccagaggtgtgtactaccacatccggctgattttttgtattttctacagagacaaagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttcgaaaaaatttatttgtaacacccaaatcagtacagcgctttggtaatccttttcggacatatgcagaacggtgaaaaaatatgcacatccctagttgaggttcaacaaggggacactttgctttctttttttcagtctttgtgccgtaaaccagtgtcttttttgtgatctatttaatgccttttttttcatttttgtactttttgttgatgattttgccatttaaaatgggccccaagcatagtgctgaagtgctgtctagtcttcctaacgcacccttgagtgaaacttacctaacacctgcattttctttgtaaggcacatcatagccttgccatggataaaactctggacagttgagtttttccttgcactgcacatggctatggtgctttacaaagaagatgcacgtgttagaagtttcactcaagtgtgcgttacagtgctgtggctgtgaattcagtgttaaccaatcatatatagtaaagaaggtgttcttaaacagacacacacataaaacaaacttatgtattaatctgctgttgcaaaatgttgtgaccagaggcttgcagaaacctaacccccagaagcaatgatttcgtattcactaattcagtgagcacagtaactgcatagaatgaacaatgagaattgactgtagctccttttttgaaagaagaggcttaattatggagcaaggcatcaggaaaaatcacaggctttcctcatttgtgtgatttttttattttgttcatgtcttcaagagtggagccctaagaagaaagctgagagctcccagtaaaggggtgacgagtgcctggcttagcctcatagaggccagaggaacgtcggtctttacactgggacattccacacacgcaacacagagttattttctatggacagttgagtttttccttttccaagcatattctagggttgtctttctgtgccctgctacatgttccactgtactgctgtcagatttttatctcccagaaattctttgaagtcacttgtcttctggtggcagcccttcccttctcttggccattctttgtcatttggtctttgttcttcagtgggcctatcaggtggcaggacagagaaatgcatgtgatcaatatgccatctttaaccaatgtcctcattatggttatgaaaataacttttcatgtaattatttttattcaagttacatattacacacagtttaaagagtcaagacttgttaaaaaagagtcccctagactcactggtttccttgtctcccaggatggccacttttaatcttttaaagtgattctttagtcttttaaatgattctttcatactttataacatgcttgtagtcttacttgtttttcaggtttaggcattatctattgacattttatttaaagtcatcattgactttaaaaacacaaaaactctttactgaaatgtaacacaggttgggtgcaatggctcatgcctgtgaatcccagcactttgggaagccgaggcaggcagatcacctgaagtcaggggttcaagaccagcctgaccaatatggtgaaaccctgtctctactaaaaatacaaaaattagctgggcatggtgtgtgtgcctgtagtcccagctacttgagaggctgagacaggagaattgcttgaacccaggaggtggaggttgcagtgagccaagatcgcgcgactgcactccagcctgggcgatagagcaagactccatttcaaaaacaaaacaaaaagaaacgtaacatacataaaaagtgcccaaatcataagtgtacagcttgatgaattatcacaaagtaaacacatttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccatttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtccaagatgactaatgcatcattcttcaggccactctatccccctagaggacttgcagtcttttttttttttttgcctcctcttttactgactgagaatgttgttaacactttcagaaacagggtgttaggatcttttgaccgttggtgaaccaacagaaagtggaagataaggatttttctccagtgggtgtttgctgtggatttgttgggagaagcccatctcatgtatgagctgtcccatccctattttgtaatattccactttgctgctggcatcagagtgaatgtaaatggaatttcccagaaatttccacagcaagtggctttctcacttagtgagcccccttggtgtttgttgagtctccctttacccaaccccacaatcactggaataaaggggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattagctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccagcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaaaagaatctttagaataggaggaggatattgagcagaaccataagaaactagtgattaagagtccaggtgtgaaaatagaaaccacgtctcagaagctcagagagaagaagaactggaaaggcagcatctttgatggatttggccatgaagaggaggaggaataaagcagaatggaggccagaaaagagtgtgtatgtctaacggtttcattggaattgggagatctaggtataccatgtaaaattacttatgaaggtaaagtttgaagaaaattcattcgactttgatttatataatttttaaaacctcattatctgttaaaacaccagaagccctgttttttggttactgattatgagtgttcaaggcctcagatcaactcagcatttatttatttatttatttttatttttttgagagggagtctcgctgtcttgccaggctggagtgcagtggcatgatctcggctcactgcaacctctacctcccaaattcaagcaattctcctgccttagcctcccgagtagctgggattacaggcccatgccaccatgcccagctaattttttgtatttttagtagagatggggtttcaccatgttggccaggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccgcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctgtttcagtagtcagtattttcttttgcttattcagtttccactgaaacttatgttttccaaatacaaaattagaattccaactttgcgtttttcaggcgcacacactcgttttccctccactccttccccagttctgatttgcttcctcctgaaaatgggggttatagcccatccactccagggtcagaattgctggataccttgttgcagtgattttttctgtagctcctctggaggttatagactcatagggaataaataatgtggtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaaaaatttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacgtttattagtttgaagccccaattttcttttttttttttcttttaagtgaaaacaagtttataaaagaagtaaagaaacaggccaggcgctgtggctcacacgtgtaatcctagcacattgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggttgcaatgagccgagatcatgtcactgctctccagcctaggcaacagagggagactgtttcaaaaaaaaaaaaaaaagaaacaaaagaatggctgctccatagacagagcagcagtatcagctgcttgactgagtctacttatagttatttcttgattatatgctaaacaaggggtgaattattcatgagctttctgggaaaagggcagagatttcctggaactgaaggtccctccccttttaggggactatttagggtaacttcccaaggttgccgtggcatttgtaaactgtcatggtggtggtgggagtgtcttttagcatgctgatgcattataattagcttataatgagcagtgaggacaaccagaggtcactttcatcgccatcttggttttggtgggttttggcctgcttctttaccacatcctgttctatcagcagggtctttgtgacctgtatcttctgccaagctcctcctatctcaccctgtgactaagaatgcctgacttcctgggaatgcagcccagtaggtctcaggcttattttacccagccccttttcaagatggagttgctctggttcaaacacttctgacatatttcccccctcccttttacagggggacccttaatccttaagaattgtagcgggacaaagatcatctgtaacttcttcaagccaaataggggtgatgatattcctgcctattagggtctcttgtatttagggtagggagaagtttagttagaaagcattgttatagaagcccttattttcagttacacaattttataaagttacaattgcttattgtaaccagctgagttttaggttttgtggtttgttgcttgcttgcttgcttgcttcttaatgccatatatcttggcatttatcagtccataattactaaattcttaaaatccataaatatttattattctttctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttttattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcagtggtaggacatcagcaaataattaatgatcttcataataaaatccttctagttgtttttagcttcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagcagtgctctatatacatttctaatgtattcctcatggttatttatatcctggtaattttgaagccctgtccctgttttgtgtttgggaggtggggagggagatagactttctctgcactaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacattagagtttaatacaatgtggtattcagaactaaaattaacatacaaggatgtttaatgaggactctaattgagtattctatgatgttacataccttccactattcatgtgtacctggatataattgtaatcctaacagttttcccggaaaaatttttaccatggtgttgtatcaagttggctgcagtttttccttcttgtttgcttgcttcctttagtcattttttattttattttatttttttggtaatgatttttcattgctgctcttcgtttattatttgtcacatcattatcagtttagtgcatggtagtttggttagcccattagtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcaattttgcaacaatgtagaatgtaccaggcaactttgtcagccccctttgcagtcattcttgcatccttttttcttctcagcaccattcatagttgtatcacacttgcttcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattctggtgagagatttatttttctccattgttttttaagagatgggtcttgctctgttgtccaggctggactcgaactcctgggcttaagcagtccttccactttagcctcccaagtagctgggactacaaatgcacaccacagcatctggctatataccttccaatgtctcactagtatatctggaatactattctattcttacgcatcttttaggtcaattttttgtttgttcgtttgtttttgtttttgtttttttgagatggagtctcgctctgttgcccaggctggagtgcagtagtgggatctgagttcactgcagtctccctctgcctcttgggttcaagcaattcttctccctcagcctcccaagtggctaggactacaggtgtacgccaccacacctggctaatgtttgtatttttagtacagatgggggatttgccatgttagccaggctggtctggtctcaaactcctgacctcaggtgatccacctgcctcagcctccacttgctgggattacacgtgtgagccaccatgcccaggccaaggtgtgtggatcacttgaggtcaggagttcgagaccagcctggtcaacatggtgaaaccgcgtctctactaaaaatacaaaaattagctgggcgtggtggcacatgcttataatcccagcttctcaggaggctgaggcaggagaattgcttgaacccaggaggcgacagaacaagactttgtctcaaaaaaaaacaagaaatttgtaacatgtaatgaaataattgattttttgtaatgtatttatgatagctggttagttagccaaccttgagcacattcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgtttcccccctcccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctgacccagtagtaaagcattttttgagtaagatttaaccaccattcttaaatctagactgagtaggacagaaagggaaatccctgtgtttttaaattttaatgagatttacagaggaagaaaaaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgggcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttcttttcttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtactttgggaggccgaggcgggtggatcacctgaggccaggggttcgagaccagcctagccagcatggtgaaactgcatctctactaaaaatacaaaaattagttgggcgtggtgacataccccagctacccagtaggctgaggcacaagaatcgcttgaacctcggaggcggaggttgcagtgagccgagatcacaccactgcactccagcctgggtgacggtgagactctgcctcaaaaaataaataaataataaactgtcctgtttgggaaattagctgttatctccttttcttctgatttctaggaaggtcagataacaacttaatttaggtttgggaatgtggaatcttagcagggattactccatttttaattttaacctggtttcctggggcctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactagaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatcttggtcatgggatgtagcagggaaacttataatttgaaagcaaggagaaccagttcatgcttttcatgtggtctgtcgtgtaatgacttttactgctgccaccactgggttattttgggcactgttgatttagttttcttaagccagtacttttcaacccttcttgtgcattagaaacatttgtggagtttgaaaaaagcatatttccttcacagtactttcctccctagaggtcctatcttggcgggtctagaaatgtggtgatctcagtacacaccccagatgagaatggctcctagtctgtcttcacttcccccaaagttcttaatttctctcttcttccaattttacttatttttatttatttatttatttttttgagacggagtctcgctctgtcacccaggctggagtgcagtggtgcgatctcagctcactgcaagctctgcctcctgggttcacgccattctcctgcctcagcctcccgagtagctgggactacaagcacccgccaccacgcccggctaattttttgtatttttagtagagatggggtttcaccgtgttagccaggatggtctcaatctcctgacctcatgatctgcccgccttggcctcccaaagtgctgggattacaggcgtgagccaccacgcccggcctatttattttttattgattgagtgattgattgatggggtcttgtcctgttgcccaggatggaaggtagcagcaagaccagagctcactgcagcctggaattcctgggctcaagtatctttccacctcagcctcctgaggtagctgggactataggcgcgcaccaccacacccaactaaagtaacctattttatttatttatgagacggagtctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcaccgtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaatcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaacccaggagacggaggttgcagtgagccaagatggcaccactgcactccagcctgggcaacaaatgagaaactctgccaaaaaaaaaaaaaattgagaataaaactgtatatatgtttgtttatttttagatttcaaaagagaagaaatagaaaaaccggctttcagtattgttgcttctttattccttataaacttttaaatttcttgccagacttatttttgttttggcaataaataatacgggttgatatttagaatacattataaactcgggaagctgaggcaggaaaatggtgtgaacctgggaggcggagcttgcagtgagccgagatcacgccactgcactccatcctgggcgacagagtgagactccgtctcaaaaaaaaaaaatacattataaactgagaatagtagagtgtattttagagattgattgtttgtttttagaattgaggtctcactatcttgcccaagctggtctcagactcctgggttcaagcatcctccttccgaggattccaatctgccttccaaggagctgggattacaggcacacaccaccatacccagctaaagtatatttttcattgtaccaaggacttattatgctattttagaaaagtcaccaaggaaccaagtattttaagtgggttaaacttagagcatagcctggacccatttgcagaaaatataaacttgggtgcaaattaggcctttgtgagagaattataacagtaacatcagccagaatcacaaacacatgtcaggagtttattgtgtgccaggtgctgttccatgcactctgtatgtcaagccatcctttcattgtagaggtgacagggtcagggaggtcaagttacctagacttagtgagtggtacagctgggttgggattaggtagtatagctcctggaatcaaattctacacacactttatcttatagcattgcatgtacttttcacaacagtcctgtgaagcagttgttttctttttttttctttgagacagagttttgctcttgttgcccaggctggagtgcaatggcgtgatctcggctaaccgcaacctccacctccctggttcaagtgattcccctccctcagcctcccgagtagctgggattacaggcacccgccaccacgcccagctaatttttttgtatttttagtagagacagggtttctccatgttggtcaggctggtctggaactcccgacctcaggtgatccacctgcctcagcttcccaaagtgctgggattacaggcgtgagccaccacgccaggccgaagtagctgttttcaaaatctatcttataggtaagtaggttaaagctctcaagattttgtggtttgttcactcatccagtgaataagggactgaactagccttagaacctaaatttataacatcaaatagctttctttgcataagttcccttggagccagtcactcatagtactttccatatgggaaggataacaaaggaacatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagctaagcaattttttaaaatttagtttttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggttttttttggtctgttttttgtttcttttgtgtttgtttgtttgtttgtgactgagtctcgcactgtctcccaggctggagtgcagtagtgcgatctcagctcactgtaacctctgcctcccaagttcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttccttttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaagaaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacatttatcagtctttttttaatatgctttgcactttttatgtcttttttgtttttttgtttttttgtttttgagacggagtttcgctctgtcacccaggctggggtgcagtggcacgatctcggctcactgcaagcttcgcctcccgggttcacgccattctcctgcctcagcctcccgagtagctgggactacaggtgcctgccatcacgcctggctaattttttttgtatttttagtagagacggggtttcaccgtgttatccaggatggtctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacacacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgcggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcaatacataacatttgaataagccagactaacatctttctaggctatagttctaatgtagagcaataaaaatagaaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaaggagtcagtaaagctaaaggcagaaaataatgaatttgaaaacagtagaaatggtaaatccaaaactttggtgggtgtccccccccctcccaccgacaaggaagtgagaagagaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtgagtacatactctgcctctgttcagctgttccagaacttaagaagaggaacttccaaattcttttctcaaattcagaaacaatgctattgaaatatattggaaacaggaacgaaaactacagttcagtttcacttataatatccattctaaaattgggaattaaaaatactagcatataggactaaatactggtacatttatctttgtttccccaaagattcactaaatgatggtaacggaattaaaaaggaggggaaaagagtccaggaattgagtactgaggcattctcaggaagagcaccaagagagggaggagatacccagcggtcacagtggaagtcgtctttgagacttagagcgtttgaggaaggggtcgtctttaaaataggttacctacctagcacttgggagaccagaccagcctgtggcaaccagtgacatcagttcctttgagtctttccagagatactctgtatattaagaagcaaatttttttttccttttttacacaaatgcattttcttgaaaattccttctcatgaactttgccagcctctctgtcttggtttgtctgagagggcctttgatgcactcttccatttaggtgctgtggtagttgaggcaaagggacagtttctgtagagtgatgagggagtgacttaggtggcctggtcttctgtcccttatctgtgtatctggagaagggagcctgaacaccttcattgtgatggtttagatcagttttatgtctgtaacccccgtgttctcttttacatactcattttactttcgtatcggttggtaaaattgtctttttttttttttttttttactagagactaaaattctctctctcttttttttctacttgtcaaaaggtaaaattttatttttccagtggtaatacttgacaacccccaggtcttggctattgggacatgtttctttacttctctgataccgtagatttagtgtccttgatatccccattgccaggattccaaatctttgccttcaaaggtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaacttagcataaagcttatttacacatttgctgcctgccagtatctacctaatacataattccaatagagaggtgaatacataaagttatttgggctaatatcctgccactacctctcttgggattctttggctgctctttttgcctacggaattaaatttttactagtcttctatctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgacaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtggccaggcgcggtggctcacatctgtaatcccagcactttggaggccaaggcagacaaatcacctgaggtcaggtgttcgagaccagcctggccaacgtggcaaaaccccgtctctgctaaaaatacaaaaattagccaggcatggtgggacctacaatcctagctgctctggaggctgagacagaagaatcccttgaacctgggaggcggaggttgcagtgagccgatattgtgccactgcattccagcctgggcatcagagtaagactccgtctcaaaaataaataaataaacaaacagtatgttctagtaactaaaaggagttggggtgactagaacgtacctttgaggggtatgcagaagttggcaggttgcagggatgccatggccatggtcagggtttcattctcagtgctgtgtatcctgagctatattgatatggcatccaaagtggagattgttgtctttttttttttttttttttttttttgagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctgcgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaactgtcaacatcagttttaggaaatgaaaggattgatgtttagtatcaaggatagcctatcaagaatgcatcaggcacaagaatagaagagtaacacagaaccaccacaggaagaaagaagcttttacagagagctgcttttttaacaaaaggcgtatgccctatttcatcagtctaaaccaccattactttaaaggtgttcttgtttccttgtttcatatactactaagagaaatgctagcaagccttcatcctgatatcagggatattaattaaaatgtgaaaaaaaaatttagaatcaataagtatggttgaagaaaaaaccacggaacaacttcatagttggattaaaaaaaaatcacaaggaatataatagtgggaagaaaatcttgtttccttgattttcatttcaatcctttggggctagctagccaactctggatttcaaattccaacttttcacacccgtcctcccgccccccacaaaaaaactttatcactgttgcctagaacaagctaacgtaaacatgtttattttgtcttttaattacttaaattgtgacctgattagagttttgtacttaaaacttgacatatctttgataataaattgaacttttaaaaaattcctattgcattaacatagttttcccagaagacccaaagtttcgttggaagattagaagagttttattttcatgcagcttaccaacacatgtgccttaactttctgaagtggcttttcttcacagtctgaacgtatcagagtctagggaatggtatgatagctttattcatcagttcatcaaacatttactgactgctatgttaggcattttgtttggcctgatactctattaaagcctcagaaaattgcttgaaatataaaacactagcataccccccagttttgggtaaacttaaagtaaatattaacataataaagtagatatgcacaatggtgatttgatagcttcagggatttactccagtttcatttttaaagtgtgtgtgtgtgtgtgtgtgtgtgtgtgtgtgtgtgtgtgtattctttttttttttttttttttttttttttgagacagggtctagctctgttgtccaggctggagtgcagtggcatgatctcaggtcactgcaacctccaccacactggctcaggccattctcccacctcagcctcccgagtagctgggactacaggtgcatgccgccatacccagctaatttttggcatttttttgtagagagggaattttgccatgttgccgagggtggtgtccaactcctcagcagaaacgatccacccgcctcagcctcccaaagtgctgggattacaggtgtgagccaccatactcagccaaaaatgtatatatttctaataaggttttatgaattagcagtgatagaaatatttccatctgtaacaaaagactgctgtaggaaaatcaccctgacctactgaaaatgattcttataaaaaagattccccccctcaattaattgcagtataatccctctacttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtcacactgaacattcagaaattatttttatggaattccatgctttcatagactcttttctgttgttgtggtatttgataaaattccctaaaagcattttttagagggccagctattaaaatctttaacagggaaaaggttgcttttcatagttagagtttatatgtgcatggtttgtgcatacagacatttgtctctttttcttccgtgtcctctcctctcccgcagtgaagttattcgaagtcattgaaactgaaaaaacactctacctaatcatggaatatgcaagtggaggtaagaacatttttatatatattgggttttttttctttctcccttttaaaaaaatacacaaccatactgcccatatgggtcatcattaaggtctcatttaacgtccagagccataatacgctaggatgagagtcggaaaagctgactcttagcacttctaggggttgccatgaagtgtttcactattagcattgttaattggtaatatctaaatacctggatattttttgtggtaaaacatgcatcactgaaaattatcgttaaaatcatttttaggcgcacagttcagtgacattagcatgttcacgttgccctcaccaccacccatgtccagaatgttttcattttctaacacgaaactctatacccattaaacactaactctccatttctccttctcccagtccttggcaaccattctcctttctgtctctatgaatttgactactcttggaacctcatacaagtggaattttacaggatttgtcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatcgaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgtttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttgtattgaattcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaagatgtttcctgaaaacacttatatctaattttctaaattagtattcttttctattgatttcagaggtggtgattctttattctacattgataagcagttgacagtgctaataatatattccttgaagtgtcacctttcttccctaaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaagaagcagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgcttagtctgatgtttacatttgtaagtgataggacttattaagtttcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacatttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgaccctttcttccatggtatttgcctaaaacagctccattagacttggaaggatacgcatcatattggtgtttccacttttctgtttcaaatgctgtggtttctttgttttttcgtttttgagatggagtctccctctgtcaccaaggctggagtgcagtggcccgatctcagctcactgcaacctccgcctcccaggttcaagcaattctcctgcctcagcctcccaagtagctgggattacaagtgtgcaccaccacgcccagctaattttttatttttttttttgtaattttagtagagacaaggtttcaccagtgttggccaggctggtctcagactcctgatctcaagtgatctgccctcctcagcctcccaaaatgctgggattacagatgtgagccatcgtaatgtggcctcaatttctgtgctttctaggagcttataagtcataattactttgactaagtaaaacaagtttttctatttatgacaaaaaggaaggtatgccacacacaaagtacactgtgtgtgatcccttttccatattcatcaccagatgggttttccccttctgcttccttcaccatgcccatcctagttactgcttatgacattttaattttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagtcaggatggtctcgatctcctgacctcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaaagagagagagaaatcctttgatctctttgagaaagggcaggaaatcaaatctgcttcaaaagcagaatttgaaaataacctgtaagagaaatctcaatatgaggaaaaactaatataaattctgaatgagaaaaggaaaaagattagataaaatttacctgtgtcctaggtgacaaagctatgactttgttttgggaaaacaaagctattttacttttcaagttttcatgctgactgaatagaacaatagtgataaatccaaagtaacagatgctctaaaacccgttttttggcattggaatttttgtaccttttgttaattataagtgggtctgatattctgaatgttaattttaaataatgaagctgcttagtaaagtgctgatttttgttatcatctcatcctaaccccagttcaccttgtccttgctgcttattctgaaccaaaatattatacagccctctgagattttatgtccacgggtgggtccatggggcttagagctaagagttgatgatgatttggaggaaccaacagtaattttattataacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaaagtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtggctcacacctgtaatcctagcactttgggaggctgagactggcggatcacctgaggtcaggagttcgagaccagcctggccaacgtggtgaaaccccatctctactaaaaatacgaaattggccgggcatggtggtgcacacttgtaatcccagctactcgggagactgaggcaggagaactgcttgaacctgggacggggaggttgcagtgagccaagatcatgccattgcactctagcctgggtgacagaacgagactctgttaaaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcattatgtgtgaacattaacaaagttattttcatcttaattacgaatctgcaccagtgatgactgactctgcgtctctcctattcagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgtgggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatatacctttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtaccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctctttttttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtgagccaccgcacccagccatgatttgactcttgaatgaggtttaggattctcccctcctcattaacagccgttttatagctatttagccgtttttatgaaatgcccctttttaaaaaaagttatttatgttttgagacagggttttactctgtcacccaggctggagtgcagtggcacagtcatagctcactgcagcctcaaactcccaggcttaagaggtcctcctacctcagccttccaagtagctgggattgcagatgtgtgccaccatacccagctaatttttaaaaatcttttgtagagaaagggtctcactatgttgcccaagctggtcttgaactcctgggctcaagtgagccactgtacctggccctgccccatattattcttgttttttggttttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatcaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcgagactctgtctcaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcattgctttctttctttcttcttttttttttttttttttttttttttttgagacagagtctcactctgttgcccaggctggagtggagtggcacaattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagcgttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccacacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctccgctcactgcaacctcagcctccgaagtagctgggactataggcacacaccaccacacctggccaatattgtatttttagtagagacgggatttcaccatgttggccaggctggtctagaactcctgacctcaggtgatccacccaccttggcctcccaaagtgctggattacacgtgtgagtctgtaattggcctggctgatttttacccttttaaaattttcctggccggacatggtggctcatgcctgtaattccagcaccttgggaggccgaggcgtgtggatcactaggtcaggagttcgagactagcctgaccaacgtggtgaaaccccatctctactaaaaataaaaaaattacctgggcatggtggtgtgtgcctgtaattccagctactcaggaggctgaggtaggagaatcgcttgaacctgggaggcagaggttgcagtgagccaagatcgtgtgactgcactccagcctagtgacagagtgagagtccatctcaaaaaaaaaaaaaaaaatttgtacttaagtgtaatatatagccagttgtggccagtaactctcataatagacaggacagccctggagaatatatggaacctcagttttgccttaattggtttaaatgttgtactgtgtcattctcatccatactcttgctgttagtgtggttaagccactctcccttttaaacttcacctagaagccagtcctttatgagacataagactcccagtgggtaggcttaccaggctctacagttgctctgccttcaaggcagcctgtgtgtcagagtcctgaggctagcgtgtgtgtttacttgcccataactataaatgttaacattgcagatatttcctttaattctactattccaggattcaggaactaaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcgctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttacatagtaaatgagaaacacctggggcagagctcaggcctgctggtccaagccctgtgttttttctccactgaagcacctcattggagtagctttttcataatcctcatctttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttagcttgttttttaaaaaatgaaaaaaaaaatcactgtttactaatcaatgagtggtattggggcaatttggtagttctcagaaaaaaaattaatttggatcaatttctcacatcttatacaaggatgaattctaattggagttaagatacaaatatagggctgggcgcagtggctcatgcctgtaatcccagcactttgggagtccgaggcaggtggatcacgaggtcaggagatcgagaccatcctggctaacatggtgaaaccctgtctctactaaaaaatagaaaaaattagccaggcgtggtggtgggcacctatagtcccagctactcaggaggctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtcaccccaaacaccaaacccatgaaataaaagacttacaaatttgattacataaaaatgaaatttctggccggtcgcataatcccagcactttgggaggccgaggtgggcggatcacgaggtcaggagatcgagaacatcctggctaacacggtgaaaccctgtgtctactaaaaatacaaaaacaaaatcagctgagcttggtgtcaagtgcctgtagtcctagctgctcaggaggctgaggcaggagaatggcgtgaacctgggaggtggagcttgcagtgagccaagatcatgccactgcactccagcctgggccaacagagcgaggctccatctcaaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcatgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcaagtaaaactggggaaatctgaacgaggtcagtggattagatcaaggtctgtttctcttcagaatctcaaatcttaaaaggttttgtattttctaaacacaaataaaagctggaaagccaatcagtagtaatctgaaagttcacaatgtcagtagacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttttaattcagttccaaataggtttgccatttagatttttgtccaagaactaactcctccccactcccggtttttgtttgtttgttttttaaatttatttattgagacaggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaatatatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggacattagtctgtcatccacatgtccctaggcacatgtccctggacacactcctcctggagtggcaggaatgactagtgacctccaccgacttcctccctgtcgcttgcatgattcctctgcttctacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttaacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaagactcatctccaaatactgttttctcctatgggagataaagcttaaacatgagttttggaggggacacattcagagcatagcacacccaccatagacactagatggtgataggtcctttatttcaaggcctggttccagttatttcggacacctgctgagccttaggttgtcaggtgctgagacatggaaagacctcacagtctaacaggaagtgaatgaaaacagtgacagtgcagatggaagcctacgtgcacacacggggaggtctgactgccagtgccccaaagatgtggtgttcacactgagtcttcaaagagctctaatgatgaagagtgttggctgagttcttaccatgtgccaaggaccatgctcagtgctttttcatggattagctacattttaaggtgaaaaaaaagttgggtaattgcctaaaattacactgccaacctgaatccagctcttaatccctatctgtaacaaaatctccccagtaagtagataatatttactaaattaaattgaatccattcagcttcagaaacttttttctgtgtattgaagtatgttctatctaacctaacatattaaagaatttgcagagaagtaaacaatcttaagattattctgtaagcacgtttttccctacaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccgggtatagtggcgtgctcctgtaatcctagctattcgggaggctgaggcaggagaattgctttaaccgagaagatggaggttgcagtgagctgagattgtgtcattgcactccagcctgggtaacagagcgagactccatctcaaaaaataaaaaaaaaagtccatagctgtgacttgttccttgctttttagttttttgttttggaagttaaattcatgtgaatccacatgacaatgattaaccattttaaagtgggcaatgcggtggcatttggtacactcacagtattgtgcagccaacacctgtctttagtttcagaactttttcagctccccagaaggagcatctgtttaggctgggcacagtggctaacccctataatctcagcgctttgggaggctgaggtgggaggatcacttgagcccaagagtctgagatcagcctgggcaccagagtgagacctcatctctacaaaaaaaattaaaaagaaaatagctgagcgtgatgatgcacacctgtagtaccagctacttgagagcttgagaggctcaggtgggaagatcatttcagcccaagaggttgaggctgcagtgagtcatggtcacatcaccatattccagcctgggcaacagagcaagaccctgtccttaaaaaaaaaaaaagtggccgggcgcagtggctcacgcctgtaatcccagcactttgggaggctgaagtgggcagatcacaaggtcaggcgttcaagaccagcctggccatcatggtgaaaccccatctctactaaaaatacaaaaattagccaggcatggtggcgggcacctgtaatcccagctactcgggaggctaaggcaggagaatcgattgaacccaggacgcagaagttgcagtgagccgagatggtgccactgcactccagcctgggcgaaaaagcgaggctccatctcaaaaaaaaaaaaaaaaagaacacctgtatcccttaagtaatcactttccattcctcctctcccctctgcccccctcccttccccctcattccctggcaaccaccagtctgtgttctgtctctggatttgcctgttctgaatattttatataaatggaaccatttcacatgtatccttttgtgtctacttctttctttgactcagcataatgttttcatggttcatccaatttgtagcatgtattttcttttccctttttttttttttgagatggcatttcgctcctgttgcccagagtgcaatggcacgatcttggctcactgcaaactccacctcccgggttcaagcgattctcctgcctcagcctcctgagtagctgggattacaggcgtgcgccaccatgcctggataattttgtatttttagtagagacggggtttctccatgttggtcagtctggtctcgaactcccgacctcaggtgatccacccgcctcggcctcccaaagcgctgggattacaggcgtgagccactgtgcccagcctgcagcatgtattagtactttgtttcttttgggggtaatattccattctgtatatatactacaatttaactgttcatctgttgatggacatttatattatttccatgtattggttaaaatgaataatgctactataaacaattgtgtacaaatttctatgtggacttaaatgttttaatttctttccttctttcttggggaggagacggtctcactctgtcacctaggctaaagtacaatggtgcaaacacggctcattgcaacttcgacctcccagacccaagtgatcctcccacctcagcctcccaaatagctgataccacaggcatgcatcaccatgcctggcttattttttctgtttgtttgttgtggtagagatgaggtctccctatgtagcccagccaggctggtctcaaactcctaggctcaagcagacatcctgcctcagcctcccaaagtgctgggattataggtgttagcctctgcacctggctgtgttttcatttttcctgggtatatatttaggaataaaattgttgagtaatatggtaactccatgtttaattttttgagaaactgccaaactgttttcctcacaactgtaccattttatccagcaatagtgagagtccctgttttcttcacattctttctaacaattaataattattttattatttaaagctttcctagcaggtatgaagtagtacctcatgcttttgatttgcatttctttaatgaccaatgatattgggcatcttttcatgtgtttcttggccatacgtatagctttttttttttttttttttttgagactgagttttgctcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatatctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactgcatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactgacattcctatttatgtagataagttcattttttctcattgtactgtatttaccaaataaatttaagacaaaaatgcccttttttatagagtaacacagcatctggtggaatgacacgacgaaatacttatgtttgcagtgagagaactacagctgatagacactcagtgattcagaatggcaaagaaaacaggtaggagattctacctgtttgtaagaaaagttgtttttcccaagagaaatggaagcatgttatttactgctttgttcttataatcattttcaaattaaaactgtaagtattctctgaaggtaagttaaatttgtatactaatttttagcaagatactagaattctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaaatagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggattgagttgatatgaggagtaacatttgttctgtaagattatggttattattcgttgaatttttagcaatatttacattctcttgttctcttttatgactcgtgtgtgtgtgtgtgtgtgtttcaacattgtcttttcttatgattaaaaactactaagaacttgagtatagcagctggggtagatagtttacagataatgattgatataggtatttctttttttttttttttttttttttttttgagacagagtctcactctgtcacccaggctggagtgcagtggcctgatctcggctcactgcaagctccgcctcccgggttcacgccattctcctgcctcagcctcccgagtagctgggactacaggcgcctgccaccactcccaggtaattttttgtatttttagtagagacggggtttcaccatgttagccaggatggtctcgatctcctgaccttgtgatccacccacctcggcctcccaaagtgctgggattacaggcgtgagccaccgtacccagccaggtatttcttaatagtagtctactctctggtagatttgtattatagttcagttcttaactttcaaatttcttctagttcaaaagtgacttaatagaaaatatcaatagaagacttaattagaagtttctggtgttacagattgtagtctacaggactacagaaatgtttcatggtcaggcacagtggctcacacctgtaatcccagcactctgggaggccaaggcaggtggatcacttgaggtcaggagttcgtgaccagcctggccaacatggtgaaaccccgtctctactaaaaatacgaaaattaaccatgtgtggtggcacgcgcctgtagtcccagctaccagggagactgaggcaggagaattacttgaacccaggaggcagagtttgcagtgagctgagatcgcgccactgcagtccagcctggacaacagagcaagactcatctaaaaaaaaaaaaagttgtttcattacctttactacttctaaattctgaaaatgcactacccagctccttctgaactttaggatatgtgactgtctgaggtgcagagtcagtctcctcaagggtgttaagactaagatctgctctctgcttccatcctgtgctacacgtatcatacaccaggcacatgcatatatgcctgtgtcttctgattctcttttcctaaaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaattattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatggctgattttttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttttcttttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgagcagagaaggattgaggacacttagcgtatgtatctttggactacatataaaagttgctttttttaggctgggcgcggtggctcccacctgtaatcccagcattttaggaggctgaggcaggtggatcatgaggtcaggagatcaagaccatcctgaccaacatggtgaaaccctgtctaaaattaattagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaaaattagccaggcatggtggcgcatgcctataatcccagctacttgggaggccgaggcaggagaatcgcttgaacccaggaggcagaggttgcggtgagccaagattgcaccattgcactccagcctgggcaacaagagcaaaaccccatctcaaagaaaaaaaaaaaaggctgcttttttttttttttttttttttttaagatggatggagtcttgcagtgtggcccaggctgcagtacagtggctagtcacagacatgatcatagtgtactgtagccttgaactcctgggctcaaatgatcctcctgtgttggcttcttgagtagctgggactacaggcatggaccaccacacctggctaattttttattttttgtagagatgaagtcttcccatgttacccaggctggtctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtgcatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagtgatgggtttttgccatgttggccaggctggtctggaactcctggcctcaagcaatccacccgcctcagcctcccaaagtgctgggattacaggcgtgggccaccacgcccagcctcaagttaataatttataatcccagcactttgggaggccaagacgggcggattgcctaagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttaccatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacatttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctccttgatctgtgtggggcctagagttacttccaccacagcaaaatctcattattgttgctgcaggaaaagaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctgtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgctttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatagagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaaagcaactataggttagcagttgctccagaatctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagctcagagtcttcataacactaaaagttaactagcatttaggaggtttttgttactgttctttaattattgttccttttgctcacgtatctgtctgcatggcatgttcgttgttgttgagcaggcagacctcgagttctggtgtggggtggggggctggcactctgtaacaatcagcaggaaagaccatgcatgtctttcataatcatctccagccccagaggaaagagacagcttctcttttctcactttattgttgttaaggagcagtaaatttcttaagagtccaaatcttgaaagtttctctctcagtcttagtaatttatattgagagcaaggtaatgtccttaaatggtatagttttggagataaaatctctggtttattatcaaaaaataatgttactattattaagttatttttattaaatgctgcatgattcttggctgatggtcctggaaattttttaaaatgttccatgtgtctagtaggctagcatctggggcctcagtaaactctcaagggtcctttgagattaacttcatttccgtaaccttgttacctgttacaaaagcccagaaatactggctgcttcaagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaacttcggtgagtcacattaaagtctgatctacttattattaggacatggaatagattagggagtattccttttttttttttttttaattttttttttttttttgagacggagtctcactgtcgccaaggctggagtgcagtggtgcaatcttggctaacttcaacctccgcctagattagggaggatctctgacatccattagcattaactagaagtcagacgcatcagaaggtttctatttaccctcttactcacttcttagcccctttattaagccacctcattttaaactgggcaaaacagaatcagccaaagagctttgccaggtttgggacacccattcatgaccagccagcaagagagacagtgagttcaatctgagaagagtctggtgactcccagaataaaccattccttcctggccagccgtggtggttcatgcttgtaatcccagcactttgggaggccaaggcgggtggatctcctgaagtcaggagtttgagaccagcctgaccaatatggtgaaaccccatctctactaaaaatacaaaaattagccaggcatggtggtgggcgcctggagtcccagctacccaggaggctgagacaggagaattgcttgaacccggaaggcagaggttgcagtgagccgagatcgtaccactgcactctagtctgggtgacaaagtgagactgtgtctcaaaaaaaaaaaaaaaaaaactttgagtttatttttcttctttgtactcttttttcagtcattttaagactagtattgggctgggccggatggctcatgcctgtaatctcagcactttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaaagactagcattgattttattacatgtatataatggaaaaaaggaaacaagattatcattgataaaaatatcagctacctctttttttttccccacagagtctcactttatcgcccaggctggagtgcagtggcatgatctcagcccatggcaatcttcgccttccaggttcaagtgattcctgtgcttcagcctcccgagtggctgggactacaggcgcccaccatcgcgcctggctaatttttgtatttttagtagagacccggttttatcatgttggccaggctggtcttgaactgctgacctcaagtgatccaccgcgcccagccaaagctaccattatttgaatgcttattatgtgctaaggtagatgtctatatacatagatacagtcatattcattttatacatataaatatgtatgtacattatatatatgcatattttatgtataaaatgagtatcatatatatacacttatatgtgtgaaatgagtatatttatacacatgtacaagtgtgcacacacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaacccaggaggcgtaggttgcagagagccaagatcacaccattgcactccagcctggcgacagattgacactccatctcaaaaaaaaaaaaaagtatcaggctgagccaggtctatctgaccagactctgcccttttagccactacactgtgctccctttagaaaaaacagttgcaggcgtgacagttgcattacatttatttcatatatttgaattaaaattggagactcaggcttgttgtttaaaaaaattctaagtggtcatcttgtttacaatttccaggctatttccacacccccagatttttgcagaaagatagtcttttatcctgtcttgttaaagtttattaactgaggtctgttgtctcccttagtgctatacttaatcagctactgacagtttgttcttaaaaacaatcaaaatccttgctagagtggttgaaagttcttatcctcctttagcaataattggtaggattaaaattgcattgcctgaaaggctgaggtgtttgcacttagatgctgcaagggagacctggtgtggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattataggaggaaaagttaagaaaagcacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagtagctgggactacaggtgcatgtcaccacgcccagctaatttttgtatttttagtagagacagggtttcaccatgttggccaggctggtcacaaactcctgacctcaagtgatccgcccacctcagcctcccaaagtgctgggattacaggcatgagccaccacacccagccttttatttttttaataaaaagaaaaaaagttgggaaatgggccaggcactgtacatggctcatgccagtaatcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacgaaaatatatcttaaagacttttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttactacataaaagtaaaattcatactgttgtcttgacacttagtttttattcattttgagatctaagactgaaaagtctacttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagactagactggccaacatggcaaaaccctatctctactgaaaatatagaaattaactgggcatggtggcgcgcgcctgtgattccagctactcaggagactgaggcacaagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatcaaaaggtaggatttatatatacacatttatttttcaatcctcactcccaaatggctcctgcaattaacattaggtttggctttctggccctgttttttccttataaactaaactttctgctgataactaaatacttaattccttgaaaggaaattgaaaagaaatagattaactctgtcaggcattttaaagggactatggtacccatgcaacaaaaggctgatgcatgctctgtgtattttctttctttggtagaattatttagcatccaaataattctgtcttcatactaataacacttagcatgctcctgtttgaagaatgagatgctcagtaatgttaatgtacaattaatgattatccacaggcatgcaaaaggtaagtattagttgtgttatttttatttcactgaggatggaattagcaaaaggctttaaaatgacaggaaaattagctaatacagaaaacaagcataaaattcaaagctacagcctcatttgatttggctttttcagaaattaaaatgtgaacagctgcgtagcagaaatgttttaatattttcagagttgaaagccactttccagcaaccactgaagaaagagtatctcattatttttacttaaagcactacagaaagtggtgttctgattttattaatattttttaggccaggcatggtggcttatgcctgtaatcccagcactttgggcggatcacttgagcccaggagttcaagaccatcctggacaacatggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatgccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctggcaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaa

SEQ ID NO: 1269 - DNA, 118467 bp, Homo sapiens; identical to SEQ ID NO: 1268

SEQ ID NO: 1270 - DNA, 118467 bp, Homo sapiens; identical to SEQ ID NO: 1268

SEQ ID NO: 1271 - DNA, 118467 bp, Homo sapiens; identical to SEQ ID NO: 1268

SEQ ID NO: 1272 - DNA, 118467 bp, Homo sapiens; identical to SEQ ID NO: 1268

SEQ ID NO: 1273 - DNA, 42177 bp, Homo sapiens
catggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggtaagtgacacttccttaggccgacccctccgagcagggccacgccgaacttgggtagaacttggggcttggagggaagcagggttccactccttccctgctgctgtttccacaaagagttatcagccaggacttcccttctgcgggcctcagtttcccggtctgtaacaccatgtgtgagctagggagctcagcccgaggggccctgctgcctcggatgggaggggcctgggctggcgttcctcccccagcccagatgtcccacagctggaacgcaggtttgtgtgggaggaggaggggagagagcggatggcagggactccacccagggcgggacagctccagccctaccagcagggagaggttatttggtgcattgtggcccttggggcacctgggcccccagccaggtgtctggaaattacatacctggggccggggggcctggcaggtgaaagggtgggccacagcagctggggggtccctgcctactcctctcccagcctcaaggataagaactgttgtcccatacctcctgggatagactgaggcagtggccgcccatggggaattgagtcggggccctctgggttccccaggctccagccccaggggcaggtgcttgcaggggaggggttctcctggatttccagccagtgggcctgccggctttggagggagcagggaccattgttccaggaacaatgcatgctggaagtttgcaaaggctgggggcgggtgggggtctccagaggaagcccgctgccgggccttcagcctttatgaaagagttcctgggaagtccgcataatccccattgaatctaaatatagttctctaagggctgtgggggttggagtgagctgagaccctgactgccctgtctggggcagggcagggtggggcagggtaccagtctggtttctgtcctgggcaccgtctccgggctctctggagtctcggcgagggataggattgctgtagcctctctctggctcaggccaggcgcctgtgggcctgtcctggggtggggctggacccgccctgtcctctgctctggacaggctgcagccttggccatactctgtgccccagtggcctgtatctagtttaaaaggtagcaggagacccttgagggccccctggagagggccagccagagctaaaggcccatcttgctgccccattaggggaaacacgccagagacaggaggggcattaagattgagctggtctcctcattcttggagtgggcttggactgctgatgctgcctggccctggggccatggtcctggcatggactcgtggaggggagggggctcctggtcacgggcaggccaggggtcctagtggagagggctgcaggtgatactagtccctggtggattctaggttcctcatctaggggggtgtcttggtctcttctggcagacaggtcttcaggggagccccagaccacccatctccagcctcccctgagcttggcctttgacactggaaactcctcttgagtgccagctgggggctcccccttccctagctggcgctggcactcagcacaccggggtcccgggctggtctcagccagggctttgttctgctctgggcccccttcttctgctttgtggtctcctctgtcacctggggcctgttgtgaagtgctgtcccacctgcagggtgctgtgcccccgggagagaagaccccatcctccactgtctctccacagggcatggggggctgcacctgccatcctggggccttacgggtgtcattgtcctgtcccctgtgcgggcctgggctgtccccagagtcccagcaaaattgcagcctgcagccctggcctggcccgctgggcccagatgtgtggacatggctgcttctgtgtttgggttgggagggaaatctctggggtggccagggagaccccagtgtgctccccggagtctggtgcactgtccagtgggccctggcctctgctctgtaaggccaacgtggcaaggggtatttagggttggtgttctaggatttccccaggggcccgtttcgtattttttaggggagagatgagcttccttgaggatagctgtttacagggaacttcacaatcatccatctgtctcatgcttggatcttcagaagcccagagaagtggagagacttgctgggacccggcctggctattagaggccctcgcctccgggcttcctgcctgtctccgttgtagagggaggcgtagagggtcggggcccagcctgccagggtctccctgcctgtctccgttgtagagggaggcgtagagggtcggggcccagcctgccagggtctccctgcctgtctccgttgtagagggaggcgtagagggtcggggcccagcctgccggggtctccctgcctgtctccgttgtagagggaggcgtagagggtcgggcccagcctgccagggtctccttgaatgtgttgctctttagcaacacccgatgcctgcatggtcctgcctatgctcatcccctgctgggcccttgcccaccctcctgccaggaggcagctcccctgagcaggttcccgagagttcttggccactgtttcctgctctgcgacatgggaccgtctttgtgcccattgcataggtacgtagagcagtgcccggaagggatgcactctcaccttggcagctgctgctgctgtttgctgagttagggactccgagtccctggggctgttggagcccaggttcccggcctacctctcccttgctgtgtgctcttgtctgcctgagcctgtctcagttcccttgtctgggcagtgagggtgaccatggtcccctatctggggacctcatccctgtggcatggataagactgtgccctccccacctttctgagctctggtgccccgtctggggccgtaggggagggggacattgtcttcctgcccctgttggagccccaggggattgtctttcctgatctgagaagggtgcttggccctgggtgtggaggggaagccccatgatgggactctggccgtggctcctgctcctcactgtgtccccacactgtgccctctgctctcaccagggtcctcaggccttgtctccgggctgactacttcaggacccccatggcctggagcggccccctgtggcctggcctcctgtggcctccagggacctttctctaatgggctgctctgtctgccctgccatagatgctgtcctcatcccaagaccccctggcctccctgggctggaggcccctcagtgtccctgctctggcctcaggggccccttctcaggtgcccccaactctgagatgtccctgtgggaggttgcagcctggtgcctcccattcagcaggcaaagctggggcctccctctttctccacatctaaggcccccctcgcttccccatgctcacccaccaccgcaaactgttgtggcagacctcttccctctccctgaccccagtcctggtttcccccacaagcaggagctctgccaggtcaggcatggggtccgggtcacctggaggtgtttgttgaatgactgaatgaccaggcttttcctcccacaccccacttgctggtggtcacccccgggactgctggggctggattccggctatccgcccctcaaaatgacagttcccatggaggatgaccatccccctcccccacaaaggatggttccctgcttcaaggagagggtccctgcttggggatccattccagctgctgacagacacgtcatgtgaggtgttgactcctcctgagaccccgtgacatttgaagcgtcagtaccggtgctgaattgattatcgcccccgatggggaaaatgatcaattctcatttagctcccgtgcatctcttgcttatccaggcaggggcctcatccttatgcccccaagagctccagaaccactgttggtgccgcctgctggtgccacgcagctgaacagtgagggaagctgcccatcgaggctgtggctctggactctcctcccggcgaagctccgggtggcccctgtgtacagggaatcagttgtcatggtctgaggctgggagccctcctaccgctctgtgtggcttggcgagtcctgtttctccttggacgctgctcatgggcttctgtttgcttctcctgttgcctctctggtttgactggaggtgactcctgccagcttttcgttcctcctgccagcttttcgttcctcctctgtcacttgtccgaggaagccctcttagccccctggatggatgggggcatctctgtctccacagcccccaggcctgtgatttgggggtcccaggtctgttgcccccaaataggcaatggtcctgggagggtaggagctgcgcccgagtggtcccatgacggatgctcgccacttgtggtcagagcccctgggcccccagacttggggctgccaccttccctcgctgcttggagcctggcccggcttccactgctgccagggccacctttgtgcctggcagtggcacccgcctcggggatccgcagggtggggtgcctggcatcagcagcattcccagctgagcccaggtgtcacaggctttggtggcagcctggggaggtgtgagggggcacggctccctggctggcaggcggggcactggctaactctaccaggaagggctctgctcgggaggccgtggagctcggagctcccagttactgttggggagggagcctggggaagggccgggagggaggaagcctgggtgggcccagcctcgctgtgcagcctctgtgggacctgggctttctcttccctggacaggcggtgctgcctccgggattccctgtggttcagcatgtgatgggtggagggcacgtccttgtgctcgtcttgtctctcttgcttctttggggtcccaggggttgaggatgggcatttgggggaggacttgagcttgagggatgtgaaccattgtcctctgaacaccagccagaagcagagatggagccctagcggcttccggggtacaagctttatgtcggggcagggacgtgctctgggggagtctggccgtggtcacatgtgggctgggtggggatgggattgtggccgctggcctcactgcctctctgctgccaggtagaggacagggaaggagggggactgcaggctacccccaaaccttcagctgctcagagtcctgctggaggggcttgtgagggtttggagtgggctaagggaatgggactggggccttcccaaagctcccttaagtaccctggaaggatctcttatttgggaatcagaagagctggtttttcccttaagtaacaaagaaagtctagttcttctcttcctttgcctgctaggaagctcacagcaaatgtgctgctcagctctgggccgcgtgggacttttcttctgctctaatgggaacgggtcattctttttgttccagttatgactgactgtagttgcatggttttgtttttagcttatattttgtagttcctgcgagccaccgcacaatctttgtgcaagacagtgtgggctatgagtaaataagtaagagtaaaagtggactgaccgtgccttggtcgtgtctgcttcagcctgttcatctggtccatggaagcggagcttgtgctgttggggggagtggctgtcagctgggctttccctggttcctggtggcagccaggctgggtggtctggcctctggaagtcctggcccaggaatgggcagccctcgtcagcctctgagctctgcacccacgctgctcccttcctgctggggtgaacactgtgcttggtgagactttctcagggcaggctctggaggctgccacccccaccacggtgtgtccttgtcctgcggggcctcagtttcccgcctgtgaacagtccttgggctgcgtcgtcactgttgcttcttccggcgctcagggtcacttttccttccagtgtcacagtgtctccgtttcgttcacgggcgtgccctggccatagctgcctctccaggatggagtcttctaggcaggacccgtgggctggggtggcccgaggccctccgcagggctgcactgtgctccgtggagactccccagcccacctgtccccgaccccagcagcatcccaggcctcagctgtagggctggggatgggtgggtggcccagcccggtgcccggggctgatggcaatgtgtagtcccgcctggcccggcgccaggtcactcagctcagcgcgctgcattggacctgggatggtcgtgcttgcgtccctcctgcgctggcctctgaccccatgtgatgggtgttgcctgagctttggcctctgtttctggcggaggtgccgcatgctggcccttgcctggtgccctcagggagctcttcctaaatgtcctgtccccatcttccctccccagctcatagcttcggttcacggctgtagcccggctctgccctcaaaaccctcacccctgccgccaacgtggcctccacaaagccctcgtcctccagccgcttgacctagcctgtgggggctgccctgagcaaggctgaaaggcccctcctgctctcgtccctagggccccctctccccgacccccgcaaatttgccttcaccaggaagaagtgtcaggcgacctggctccaagctttatcttccacgcctggctctccatctttttctcctgagggtgggactggggccaccccatcagcccagaggctccccaagatggggccagcagggcagtggcaagggtgcgtctctgggccctggagtcacccaggtctgagttggaaccccagctctgcgaccctggtggtgtggcctgaggcaggtgtctcagtctctctgagcctcagtctataaaggggtcacagactcctggtagccagtgaacagggtggttgtttttgggggtgggtggcccctagggctgtgcagggaggcctggggtacctggcaggggagtgtctgggtgttgggatggtgccaggggcccagcttgcctgctgggtgattgggagaaggctcgtcctggtcctgcccaacttcctggctgcatttggtgttgtgggaggggctgtagcttgtggggcatggggtccctgccctctatagatgccctagaggcctgtggggagagggtcctgagggcggaggccaggaggtctgaactcatccctgtgcctaccgagtggtgggaagagcatggagggcttgggcctgaggagccgggcagcgggtatgcagagggtggcgaccaccgcagatcctctgtgcctgctgctgccccacgtggtggggaagaagtgggggcagccacagagccaggctgtccctggcttctccttctccactgtgtttccataagcaaactgctgtgaccatggggagggccctgggaaggtgcagtcccggcatccggacggctcctggggcggcagtgtttgatctcagagttaaaccaaggagacggggtgagggtctccaaggggtgggcatgtgaaaagccccgagatgggcctggctggagctcacgtggagaccgccacggggcaggccaggtgacaggaggcgggcgctctgggggctgtgtttggagtggagctgtgctccagccctgggatcctgggcactcttggcagcctcgtaggaggggctggtggtgtggacagtcctgtggcccctcacatgcagaggtttccgggtttctgcccagggatgcctggggccgctgggaggcaggggcctgatttgaaaccgagtccacggggccccttggttcacccggtgactgcagcctacatggagttggattgagtgtgcaggtgacccccaggcccctgcagtgcactgagcatgcctctgagcattggggctcctgatgagcctgcccctctgccaccccacctcgccggggccatccttgcctgtctggcctttaaccacccataaccccagatcccagtcatggcatgcgatggaggacaggggaggccattgaggggatgagggtctcaatgagcttgtctgtgccccgagctgcccagctggactggcgcctggcacaggcccttggggatggcgtgccggccagtgctgggtggactgggttgtgtccccgctccctcccctcccagcagaggaggaagggggtaggaggccttcagagctgcagacccacaggatgggaatggtccctggagtcctggctggcagaccagggagggtctgggcctttggagaggtgcccagctgggcaggaggggcaccggggcagccaggtgtggccagccagtttccagactggagcaccgagcccgctccttgccccccgccctgatgggctgcaccagacgtggaaatgtcctggacagcaggacctgcgagggctgctgcctggccgggggtcccttcctggacctgttgtcagctccggaaacagcggctgctcggggttgcagcccagcacgctttgtttgggaaggaaagggagggcaagatctggaggtcatggcccatggggtccttttgagggctgcccgcacacgcatgcctcactgcgtgggtcggggaggggcttcggggcctagttaccctcccagcggccctgccagtgggtgccagagctcctttgtggagacgggtgatggggactcagggagggccccgtatggctgaggtctgggggtctgatggcgtggcgtctctgaactgggagcaggactcccctcgctgtcccagggtggccttacctggcggggaggtttgatcagctgttctttcccatgggcagtggcttggctggagtggggagacttctctcctgcagtgacggggagcggggagtccccggtaaagtcccccgggcctcacacgcaggagaaaatggaaggattacttaaagcaactcggagaccccagaaacaaaataaagaacaaagtcatgatttgtaagtaggggggagactccctaaaacccaggcgcgcaatgggtgggctatgtttgatgctaaattgaatcaaatgaagaaaaacattttccaaatgcaagtaaagtatctgtgtaattagaccataaagagaaaattaaaagtcatatttcgcagtggagtaattactgtcttcctcaagacaccaggctgtggaggcctgggtgacaggcgggcctgctggctggggctttgaggagttcagattcctgaaattggggggcagtaacccgttgggggcttgggccagaggaccccgtgagctgccgggatggctgggagaggaggcctggtcccactgcccagcctgtgcagaggttggaaggtgcaggaagtggccacagagcaggatttgttgttgttggcggtgggggctgtgcgtggccggggagggggagggggaggggaggggcagggctgcagggctgggcggcttttgtctctctgagggctgcgtctggggtctgctgtgcggggagcagtcagtggtgtgggagaccctcgccttcaccttctggggcccaagatgcccatccctgggagccacccatgtcagcagcggcctccctgagcccctccctggagccctgagtgctggtcccgtgtgctgagtggggtgccgagttctcctcttgtcttagctggacagtgtgctgggccccaggctggtcctgcaaataggaggtctcgggtcctctgggctgggctgtgtggctctgagtggccccggcaagcagccctgtggttctgttctacccgagcagtctgtgccctggcccctatgctgtgccagcctggtgcagcctggctggtgtgatggctcagtggtgggggcgatggcgcctggtcccatccagtgtcttgctgtgttgccctaggccggtctcgcataagtgactagggttggagagatggcccctgccctgtgccttgaattcctggggccttgggtgggcctctcagtgccccccatggagcctgctgggtcggggttgggtggtgagagtccctgagaggagggcctcgtggcccgtcctggggaggggtgcgtggcccactcgtgggctttcgctgtggggcccggcctccaggatgctggctggcacctgggctgctgggggaaggtaccctggcccagatgcctgggccgccgctgttgctgagcaggtgaccagcagcctcggcttgtccccagtgggggcttcagcttgatgggcccccctccagcactggcccccaacacctgggacttggatgcccggagctccgaggcctggatagggctggggcctccctggcagctgctgtctgaattcctgatggcaaagctgggtgggggcttgggtgggggccactttggcttcctgtccccttttccctgttgcccctctgcctggccagcccgtggtgggtggtgcattctcaggtcgatccgggcttcctccctcccctgccctccactctccttcctgcctcctgctgtgcagccctggagagaagggcagggtgggcttcccaaggcctgaggtcgctggacgggcagaggctgcctggcctgtctggaggctccagaacggcgagctgggggccgggctgcctgtcaggttgggttaatagctccagcaggcggggacttccttccccttcacacggggccaccagggcagcctcctgctgagtggaaaatcagcataatctgagcctgactggaaaacaggccctgtctgccctcagcctgtgcaggggccagttctgggttctacatgtagacctgtgtgcccactggccgcatcagcagagctaagcggggctcctgcagtgtctgctctggtagggccctccccctcctggtccccctccccgtccccctccccctcctcctcctcccccttccccttctcctccttcccctcctcatccccctcccccaccccctcctcctcctcctcctccccctcctccttctctgcagggctccttgtggctgacctcagcgaatctccgaagcagcaggagggaggggcattggctaatcgggaccagacgcgccaggcacttcagaggctctgcaggccctgggttggaggaaatccaggcctctggagtggcccataaatcaggcagctgggcctgatgggggtcgccttttcatgcgacctgcctgggactgtggggagtgtgaggtggtcctgggggaacatgattgccgcacatgcttggctggcaccggccaccctggaccacagctgttaccactgtgagcctccagggcatctgtggacaagggcccagccagccaagggcaggctcaaggaatgtgggtggggtgactaagacaccccctccccgggataatgggcctcagcttcctcatctgagaaatgggcacgtttgagaaggctgcagtgccttttgtggccaacagggtggctgcattggagtccggtcttgcctggaatcccttgaggcaacatggccagccatcgagccagggactgcctggggccaggtttcgggtggtgggaaagttgggggctggtggaggacccctgtcgggtggtgttcggaaagccctaggtggtcacagccacagcagcgctgggctggtgctgtcctgggggttgcccgggctgggtgccctatagctgagacaccccttggggagggggtgcagacgcagagggcctggccccctccccagagagcaggacagacactggtcctgactctggccctgactgttgcagagtggtcccaaggaggggcaaggccagagcctggtggggtggtgagggacacgggtgggccccagagaggagtaagcctcttggtcgattccctcccagtgagctttgctctgtggcttgtctccttcttgctcctcctcctcttcctggaagatgtcactgcctccaggaagccttccctgactctgaggctgggtgaggcgcatcctcctctgggttcttctggctcttgtttttagccgtttctagaacccagtctcagggttctagagaaacctgtgtgtccccccagttcagggaagggggcagtcaccaaacagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctggtgggctctgggtgccggccctccctccccaggcactgaccctgcctttgtcccttgctgtcctcaggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgctggcctccttgtcagaactgggcttccttcgggggtctctgtccacgttgagtgccctgcagtaaggcttccctgaagggaggggacggcgggcatgggggttcctgacactcctgaggccccacatcagatgcacccttgatggtgcacagcagctgttctcaggtccctgcctgactcagggaataccttctctgggagcacgtgcccctccctgtctgtcttttgagactggggctgagggcccaccagtgcccagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctggtacactgtctagtcaccacacagcgaccagcacaagctcgcccttctcccttggtctccaggcctggtggtgtttccaggggcagacagaggtgcagagaccccgtagtctctggggcaacattggccactgatcctaaggccaggcagaccctgcccttgccttctgggctttcggcctccctgtgactggtgaggtggcctgtctggacatcaagatcctgccccagctgggggctggccttggcactagctgccctggcagtggctgctgggctggtccttctgaggctgctgggctgccctaggggtcgaggtacgccgaggctcactggaggaacttctggacaccccccgggtcccagctggtgtgatggttcccctgtggccttggcacctacacccttccacctgtgaactctgtggtgaggccgaggagagggagccccacccttgccacgaggtgcctcctggccccagagctgaaccccacccttgccatgaggtgcctcctggccccagagccgaaccccacccttgccatgaggtgcctcctggccccagagccgaaccccacccttgccacgaggtgcctcctggccccagagccgaaccccacccttgccatgaggtgcctcctggccccagagctgggcatcctgggaggggtgggcggggatggtgctgggggctgcagcaggtgagctgggcagcatcctggaggaggtctcattgagctgggcctgtgtggaagcatcaggggctgggcctgaaacccaggatggtgggcacaggcacctccgtctcctgctgtctccctgggccacttggcctcactgcaccctgcccgtggctgagggtcccagcgggtgggggtggagaagatcgcaggccccttgctgggcagccctgctggtggatggcacaccatgaacatttaggcaccctctcccagcgttatgtgcacattgatcgtggccagggtgggtgggaatggatttataattagacagcagtccgggcgatcgatagggagattattagaaccataaatagaactttaggattcagatgaggtaatttcccctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacgggggtgctgcagccccctctgttacacgatgtggagaggaggggcagggaccagccatggcactttggcctcggccgaggcttggcaggggatgctgaacgttactgggtctggccagaaggctggtccttggaggggtggtgggtggcccagggctcccagggcctcctgcggccacaggtggggcctggaacatcccacatcttgagcatccagagactcctgggctatggagccgccgggcagggctgtccagcggttcttcccggactgttgggccggggcagcgctgccgttgcagagggcagaagctgcccacggagcctggccctgtgcctgtgccccacgcctcctgccctgagagctctggacagtggtcatggggcccaccccagtgccctgcctgcaccaccagaggctgccatggtctgggacatgctgcgaaccgtggcccatttcacgctatgaactgagctgcgagaccgaggctctggccttcagagcccacagtgggttgcaagtggcaccgtggccctccacagaggggcggcccggtgggcagtgtggggtgctggaggtgttgacggtggccctgaggagcgggggtgcctccatacatggagattgggtggcaccggcttgggggctcctgccaccgctgtgctgggctgcaggggccctggagggtgtcccgtggtcctcacggctgagatgggccaggcaggggcagatctttgaactcagggctgtccaggccctagggccctttgagtgacgaggctggagcttcgcgtgggtgggcgagtccgccccatggggctctgcagggtggcgcacatccacacccgtgcaggggtgacactggtgacagagttcggctctgagcctccctggccgctcctcagcccctcctcctccctttctcccccacttctcagcacaaaatagcacccagtgaggtgtttatctggggggctggtgtctttcacgggccagaaccttacagatgcgtttgggcctggagggctcctaagaagagagttagcttggcatttcctaaactgtgctccacggaaccctggtgttccccgaggttgcaggtgctctctgctggccgcctggtgcctgctgtggttaggaagctccccgtggggtgggtcccgtgcggctatgcttggggcccttggctctgcgcccctcggcctcacgctcccctctctcctgcctttccttccgtttgctgctgtggcacctccatcacatgctctgtctggccgcccgccccccctctcttctgcccccgtgttgtggtcttccctctcgccgtcctcccctgcccccggctctcgctttgccagacggcttcttttggcatgcccgggctctgcttccggcaggaattggcagtggccgtcccggcggatggggcggtgtcccggcagcgcgtgggacggtggagccgaggcgcgtgccggactcctgagacaggtcagtgtggggaggcccagctggccgcaggcctgtaccgttgctgggcggggccggaaccttctggccggaggtggagtggctggcctgagatgggggagggctcgggccctgtgggaagagggtggaggggccgggtgggctgtggtgtagcagctctgtccctgctgcagcccctccagcctcggtgcccctgtccagtgggggaggcagggtgtcctggtgcctcactggacactgtgattgggcctggcccaggatgccaaatgtggccccacggtggtgccatcgcgacgagccacctgtgggtgccacgctggctgtgggtggtgcggccccggcccccaggagaactggccctgggtgctgactgccatgcccaggggtgctcaaccagacccggctctgctccaggggctcaggacctgctgttaatgttgtaactttaaagatcactctttcctgtctgctcagcaaaggagtttaggcttttgatagggagcacatacattaagtgataaaatagaattcacacttgaggtgagggagtggctgggagaaggagagggctggccgggctgggttcagagggatgtacaggagttcctggcctgcaggctgctggtggggtgtggtgtgctggcgcaatgtccagtgagctgttccaggtcccaggttcgcccttttctgctactgggcattccttctggaagccccggaggagtggctggtgcctagggcccagggggcacccagcttccatccagcctaagtcttggggctccctgtgaacttcctttcgcagacatggttctgttccaggtcccgggaggggcctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctggagtttgatgggggagaggcggaaagtctggcttctggaccaccatctgcctccctctctgcctccaaggagtcctgctggggcagaccgcccacacaccccgagctgggaacgtgacctcacggcccaggcaggccttccccactggcctctctgccagccctgatttctggggccttcccggcttcacaggctgggccctgggggtgcagagcccccaggaatgtgctgggctctggggtgcccaggcctgtctctcccactccgggtgccagggggcagtggtgtctctgcccttgcgttccttatacgcactctctccttccctccaggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataaggtatgtcctggggcttcctgggcagccttgtgggcagggccccatggccccggctgtgggcccctggggacctatgggccgttcttgggggacctcgggcatgcttgctgctgagacgagtggatggggagctgctccgaccacagctgctgagccgctcacagcctgccggcctctcgggccccatgcccgatgttggggggcatctcatcctcgggggagcactgccaaggaggggctctgtggccaggaccctgcctgagttggagcctggtccctgcctcttctgagctgtgcaatcttgggcaaatcaactaacctctctgtgcctcagtttcctcccgtcagctgggctcttcctcataggagtcgctgtgactgcagcaagaaaatgtctgtgaagcctggagaatgtggcccggagtggggcagctcagctgtggacattgggggctgcccgggggaggcgcaggctggggccacggagaggacaaggctggccttcaggcagcacaaggggaggggcagcagggcttgagcgggtgcccacggtgccagccgggcttgtggttggcaggtccagctccaccaggagcatcccacattgggggaccatgtctgacatcacttggttgctttcccaggccccgagctcggggtgcctggtttctctgctctcccccctgctgatccccaccactgccagaatgccaggcctgaggccctgcaggcaccaggtccttgccgactggtggtgtggatggggtgggccaggcagagggaacaggagagcagaggtggggagggggagttggcatggaggggcgtggtgtgggagcctccactgggcccttcccggcagggcctttggtcctgggacccgtggcagagcctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccgtgctcctttgggtcctgtttggcaggaggatttgaaacgtggagacttccagaaaagaaagaatagctccagtgctcagagctcccccggtccctgatgctaagccccctggtgccaaggagggttcctgacactgggaagtaagggtagggtgtcggcccccaggccggtgcgttggtgacctggagcccagcagagcggccctggctgccttttgtttgggagccgaggccggtgccgcttgccagccgcgctgcctgctgaccttgggaagttaccatagaaaccagcgcatcgggctggggacccagaggcggttctcccaaggcgggggcgctgccggctgccattacttccagcctgttaggcaccctgggtctcagcggcttctgcgaggccactgcaggtggcaggtcgtggttcaggttgtggcgggggacatcctggcaggtgggccctgtcggtggatgcctgacgtgggctggggtcggtggtgggtgacctcctctgtggggctgcagtaccctgaaccctcaggggtgagatcagagggggtgtccactcctgggttttgtgggtgtggggctgtggctctgagtggggacgagtccaccaggagacagtggagcttcagcccccgccccaggggtcttgggcacgtgctgagggtaccttctgtgctcccacctccaccctcgaagaggacctgggagggagtggcactgaccccagcccctgctctgcccttgggaagtttccagtctggagggaccgaggggcacctctgtggaggcagccttagatggcagcacgggacccgtgtagcagtcagggcagagtggcctctcagggagcgggctttgagggttgagtaggagtctggcaggcagcattgccaagtggagacggaatggggtggaggtcaggagtttgagtttttgaatcccgtgggcctggggagtctcagctctgctgctgcccacaagcaccccccagccggattagggcaccagcctcaggctgccccctgatcctttcagtggcctctgggctccttatgtccacacagggaagctgggatgtggagtgatcccatgggtgcccgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtgacccccagggttaggagttccctgaaggttctggcaactctgatgacgctgtctgaggccccgctggtttgtgccggcgctgggagcctctgcagtgcctcctctgaggtacttccgtcatcatactctcacctgctcgctgccatgctggtatgggggtcccctccaagaccccaaatcaaatgtctttgagaaaactgctaagggaggttgcttccattgggtggggagcacctcatggcacttgcaggtacccaggccccccactccccaccccactgtggcctcagcagagcccccgtgtcagcctggatgcccaggcccatggacggtcaggctggcacccagcagaagtgcagcgcctgcggggagagtgcgctgcccgaggcttagctggggacccacatggaaggcactgtctggagaggtgtccccacctgtcttctggcctgtgggtgaaaatccaggacacaggaagtgtggaccacagcagggctgggagttggaggggctgatgcctcagtctccagctgcctccagctggggtccagggtccccttcgcaggtctgcaggacccagctggggtcccccgatgcctgccctggttccttggtggggcaggtccggcaggtggcaggtgcccctggggtgaggtgggggtagggagggtggggctccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctctgtaaaaaggaaaatatttccttttctgttgacatgaatcgatggccagggccaatgagcccaggcaaggctgtgggattgcagcaagacacctggtggctctgggggccgttcaggtgcccgctgtctcgttcatcctcgctcacgcgtgttctgagcttcttctgtgagcatctgcccccagaccccctgctggcagggacatagctgtgtaaactggtgtctcacggcagggggtagttgctatagaagcaggaggcgcaggggctggggacacccatctcagggcatcagggcaggcttcctggaggaggtgtcctgtgaggatgggggctgtttatgcaggtgaagttcctgcttttctgagtcttcccttcagagtcaaacccctcagacttgcccactgagggccgccgctccctggcagtgttgggtgtgggcagtgtctgctgtggcctgggggagacaaaccccactgctcagaaagtaagttcctgcctccacagggccgtgggccctcaagggctgttgaacccaagcgtggtagccagatgggggctgctgtgtctgatggtcgtttccatgggggcctgaatttcatcaaaggagaaagtgctcgttctggggcctcgttaatgcagtggcaggtctttgagtcataccagtgaggtaagcccgtaaaagcaggcaccgggagggcccagcaggctggggtgcagcctgttggcgatgggccccaggaggaggaggcgcctcaagttaggtcagattgtggggtggagatgtggggcgaacaaccttccagacttccagggctgatggaaccacagaggacgcccggtcccagcctctgtctaggcggcctgggccctgggtgtgcccgctgtggcccaggcatacctgagatctgtgctgcggacgctgctcctgggagggtcactggaggggcagagcccttgtgtggccgacggggcaaagggccagcctggttttggcctctgcagacctaaggctccagcctcaatctccctctggcctctccaagtgctgctccagtctccagtgcttgcccggcctccgcgtcccctggaagcttgggggtgtgggtgccgatgccctattgcccacagccttgggttgcagctggtaccttgaccctgcccagccttgggaggggctgcaggggagggtggaggagctggctctgggtgggcgtgacctctccccatccacttgaggccgagccaacaccctccagtgagggctggtgctgggcgtcccccacatccatttccagaggaggaaaggggtccagggaggctccctgtcccttataggggccaccgtggggaccgtcctcagccctgcctgtccaggtagggtggggggcttcccacctgcacctgcagggccctgcccttccccccgccccgccccaagaaacctggggtcccagccttggagcagcaccaggcagcagggtggggtagccctgtcccagtcctgcctgctagatgcggatgttttccaaagcggggccgcagcttcttcccttgcaggcagctggcgggaagctgaggtgtaacccaaggtcgtggggtggggggtctggaacaggaggctgaggctggggtggtgggcaggcaggaagaaccccaagagcagacactggtgaaatccaagcctcctcccacctgtgcccccaaatgggcagatgcagccctgcctgcctgcctctggcctcgcccaggcccctgcccagtctccctgcccgctatgggggctcactttgaggtttgggttgtggctctgccctctgcgcttcccagcgttcccctctgcccgggcttcttgccctgtggacagacgcacagacacacagacagcgtgggcgagtgtgtcggcctccatcctgtccctgatctgctgtgtgagtgatctttgggcgacgagggcacaagggcctcttccttgcagggcagttgtgaggtttacagagacgaggcttaggcacggtattgggtaaatgctggcgatgctgggtgaggtccaggggtctcaggcacacaggcccgggccccacgatgcaggtgccattgcctccccttgcaggcctccctgccgcgttgggccccaccctgtgtggctcagctaccagagggtcacgaacctgggaccccagtgaccccggaaccccgagcatgcgcggcacggggcggccatgggccccgacccctgctctgactcacacctgcatcctggggcccaggcccgtgtgcctgagacccctggacctcacccggcatcgccagcatttacccaataccgtgccagctgtgggcaaggaacccaagtccccgaggcggcgggtgggcttcccacacctggaactaccggggcttctcctgggtagccgtgggtttggttcctgggattcttcctcctggcatcccccggctccacgtcttgcctgggtggctgcaggcaccgcccaccactgccctactaaggactccaccatgtgtcatagattacttttactttccacgatgacacctcactaggaggaaagccgtccctggggtctcttaagagacagctcctattcaaaatgaaagaaattaagcaaaacgccagcgctgcagccgccgcagtgggggcagcgagaggccgggcccggctctggggtgcaggtccttccacactggggtcagttttagggagtcaagatagacgtgagaggccgagggctgtggggggggcgtggggcatgttaggggacagaggagcccagggtgggtcgggggagcgccggtggtcagcgttcaccacacccttcgccgggtggcatcctggcctctggcccgcgtgggagcgcctcctgttgggaggtggtgacacccagtgtgtgtgttcgttcacccctgtggcgtcctggtgtccctgtgctggtgggtccatgatccggggtaggggctctgggtgcctgcagcacaaaatgtgctgggagggtgtggggccctgcagaggtggggtgggtgggccacagagaagccaccccagggaatgagtaggtgtggcccagtgatgggacctgggaacacatccccagcagcagggttagcacagccagggctcagaggcgcggcgggcctgtactctgtgtgtgtgcctgtctgcgtgtgtatgtgtgtgctctgtgtgtgtatgtgtgtgagtgtgtgtgcgtgtctgtgtgtgtgcgcgtgtctgtgtgtgtgcgcgtgtctgtgtgtgcatctctgtgtgtgtgtctgcatttctctttctctgtgtatccttgtctctgtgtgagtgtctgagtatgtgtgtgtgtctctgagtgtctgtgtgcctgtgtctctctgtatatgtgtctctgtgtctttatgtgtctgtctctgtgtgtgtctctatgtctctccgtgtttctgtatgcatatgtgtctctatgtgtgcgtctctgtgtgtgtttctgtatgcgtgcacgtgtctctgggtgtgcctctgtgtgtgtctgtatgtgtatgtgtgtctgtgtgtctctgtgtttctgtatgcatgtgtgtgtttctatgtgtgtgtgtctctgtgtgtgtgtctctgcatgtatatgtctctgtgtgtttctgtatgcatgtgtgtatctctatgcatgtgtctgtgtttctgtatgcatgtgtgtgtctgtgtctctgcatgtgtttctgtgtgcatgtgtgtctctgtctccatatgcatgtgtgtgtctgtatctctatgcatgtgtgtgtctctgtatgcatgtgtgtctgtgtgtctctatgcatgtgtgcgtctgtgtgtctgtatcatgtgtgcgtctgtgtgtccctgtgtgcatgtgtctctgtgtctgtatgcatatgtgttctgtgtgtctctgtatgcgtgtgtgtctgtctctgtgtgtgtttctgtatgcgtgtgtgtgtgggcctctgtgtatgtttccatgtgcatgtgtgtctgtgtgtctctgtatgcatgtgtgtatctttgtgtctatgcgtgtgtgtgtgtctgtgtgtttctgtatgcatgtgtgtgtctgtgtgtctatgcatgtgtgtgtctctgtctctgtatgcatgtgtgtgtctgtgtttctgtatgcatgtgtgtgtatctgtgtttctgtatgcatatgtgtgactgtgtgtctctgtctctgtgcatatgtgtgtctgtgtgtttctgtatgcatatgtgtgtctgtgtttctgtatgcatgtgtgtgactgtgtctctgtgtctctgtgtgcatatgtgtgtctgtgtgtttctgtgtgcatgtgtgtgtttctgtgtgtgtctgtgtgtgtctctgtagggtgtgcgtgtcgaggtcccctgggagtccaccccagtggctcccaagcatgcactggcctcccctggagggtgtgttaaacccaagcgtcagcctctcccctggaggtcctgtggtccgggggctttgggagactctgcaccttctgggagttccctgggggcactgtgggtgcaggaatcccccacccctggcggtgctggggcaaggctgagcctcagggtgggctttggggtggggaggcgctcgccctggctgaggggcagggtggcagcgggggcacttcccagcagccctgagtgacgagggtggcaggggcccaggagctgggcagtggctccaggatggctctagggccttggtgatcggcaaggggcaaggcagcctcacctggggcctggggcttggggtgtggtaatctcgacagcaggattaattgagcccttcctgtatgtggtcactgtgctgggtgccttgagtgtgtcagtccattagggccacacagaggcctccattgtcacctcatccgactttggagatgtagaaactgaggcataggcaggccaggtggatgtgcccaggtcacagctgtgcatggctgcccacagcctgggcatcgggtgggagcagctttcactgtccgacccccggcagcggctgcaggtgggggatgagggcacaccccttggtggggggatggcattcagtgcagagcacagggaggggcgctcagcctgtgtgggtctggaccctgtcacaagcttggtgtgaatgctgggcagagtccctggggcagggacgccatggaggccccagcctgaaccgtccactgtagaaatgaagtgcaggcctcccagccacattttggactgggtttcctgggatggtggctgatgaagtcccagggtgggatcgcctggtgactcgcaggcgggtgacaggaacagctgctgtcacccaccactgatcctgcctctgcctctcctccccagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtagacgcagccccgagttcggggccctgggtggggaggccagaggcgtctgagaagacgcaggaggggtgagggagtggaggggctgccacttccttctctgggttggataagggtggtcagtggggtgccatggggagactgaggcccaggtggcagcagggagcctgggagcctgtgctgggctgggactgccgggatgggaggggagtggcgtgtcctaggggtcccaggggcatgtactaggttcagcgtggggcgggacagccaggtcacggggctcccagggactaaggttgggtttgatccagggaagccccttgcgtaggctccactgagacgcagccctgagggggctgggggcaggaggggactctctgctctccagagtcaccgtgtgcaggcgggcccctgccatgggaaagcgggatgcgtgatgggttgattctggcgccgcgctccacatgggaagactgccgcctgtggagggcacagggcctccatcagtgatgggacaggctggctcctggctgtccctggagctctgagcctggggcctgtggcttgctggttgtgccatccgagtctcggagaaatacctgccctggctggacgtggccctgccttgtgctgggagctggcagtgcctggttcgtgggcccattgagtcaggtgggctctttgtgcccatggagggtgggaagccagtcacacagctctgtgtgtgcccccggtggctttttcctgcccctcggcctgctctgcagccagccccctcccgcccagcaccccgaaagcactgcctggtgcctccaggcccgggaggctctgtgccccacatgggccatcaggctccgtgcccctctggacttggaccacgattcccaggggttcagctctccaggggacaaggtctggaggggacgctgtgcccacgttggagaccccctggcagaaggcccctgtccctgggcctgggggtgccacaggcctctcccactgccctagctgtactgggtctagggtgccaggagcacccctcgcagtcctggtgagagcctgcttgacctttacagctctgtagtcctggaggggcctcctgggcagccacaccttgggattttgttagagctcgggaggtgccaggctcgtgggagggtttggaacatgctggctacggggaagggctgtaagtgactgtgtgtctggccacgccctcagtggtgcagttgctgggggctgtgccccctgcccgcccggtgatgtagcgagcattgtacttgcagcccctggaacgctaatttcgtgacttgagccctccaacctctccagggcagccctggcctgaattgacggtggctactggtctggggcagtggtgggtccctagggagggccgccgtggggcataggggctctggggcggcctgtggggcagacctgacagctcttaccatcttcataggccatggcgggtccgggtgggggcatcaggcagttggcaccttggagctgcatgggtgtccagaggggagtgtgtggtgagaccaccaggagcctcccgatctccctgactctgggtctccaccccgagcaccccaccagttgccagggtttgaatggatcgcttgtccctctgggcactggtttccgtttgtggtaaggagggcttggcgggcatctggcatctctgtcctccggaggcgacattctgcatccaaggcccgggggcaggggaagctgtgtggcctggatcagggacttgtcattgctccgctggggttggggcaaggcccctgcctggggtgaggcgggggtggtgggtgaagcagagttgggggactaggccgggggtcactgcctccctggaaatctctttgcctagcactgctgggggtctgcggggaacaagggggctcctgatctctgtgcgtgtgcccggcacgggctgtttctccacagtcccctgggatgcgaggccagtggcatcagcctgtgttttgggcccaggcctggctggctggggcaccctgggtcctccccaccctcaacagtctccttgagacagggcaggtgggtgctggggccaggctgccgctgccctggccacgtgggctgcagagctgtgccgagagctcaggaggacgccgaggtcaggtgtgggcggtggtgggcaggcagcatccaggttccccgcccagcctgggatcggggccctggctctggcctgggcctggcactcagcctgtttgtgccatccagttggggcggggggcagaggagtcagcagctccttcaggagcccgcaacacttttcccagcgccccgcgtttcttaggggacagcttctgccccacttcctcctgggggcagccttggccgggcttctcccttctctccatggcagtcacacccccaccctgctccggagtgctcagtgcttccccagcaacaaggagccctgggtcaccagccttccagcccctccaccctgcacaccccccagctccccgggtgttattagcactaatgtcacatagtcagaaatgccgcctgaaaggcgtttaatattgtcacagaaaagaagttagattacgttcaatttctgacattaatgtgctacttaagataattcatcacagtgtggtataaaaaagacatccctgtctgggtgggtgctgagcagcgcccttccccctccctgcctgggctacctcttcagagctggaagcccttttttaatgcaaaatgtgttttttctctcccaggcagctattccgtggggctttgtaatatctgaacatttaggggagaggcttgctgtgccttttcctgcaaagaccctgtcatttccctgcagtaatgacagggttctctttcggcagacaatggcctgcgctgggaccagggcagtgtggggcaggctagatgggcggtgcccccactgtgggctgctccatcccctccctggggaggcccacaccccccttcctcctggttgtgagcccgctctgcgattaatgccgctggtggaaagggtggccggcagacgtagagagccaaaccgtgagcctctccacgccactccttcccgctaggaagtctctcaaatctgcagagcccatttggctcctgaagtggtgaggagttcacactggaaaaaaaattgccaaaaattaccgggaagtgcacgttttcgtctgctttgtggtggcgtctggaaatgaaatagttttgatcacgtcgtcgggggaataaaagaatcgattcttgcctaatggagcccaggttctgagtagtacaatagaaaagtgtttcttcatgctgctccccggagagcgggcactcccgactccagcggcttgcatatcaatgtgccccatgcccagggggagtaggtgccgcctggtgcgaactacccatggtaaaccaattttgccggcgttatgtatctgtcacttacaattaaatccgtgaaaaatattggctctgaaatgagtctcgggtaatttgatttacgctgtagtggagaaatcagagatttcagcgcagagtggactgtggtgtcctccagcaggaaatggggcctgtctctggctctgcgttggagccctggttcagggtggccctcgtgtgcgcagcctctgccgggtcagagccgccgcctcctggcatcgacgcaccagacccacctgtgtggggtgtccctgctgtggatgggtttcggagtgtttgcagtgattgctctgggctccggcatcctgggtcctgcccctccccggcgtctgccccctctcagggtactggggctggtgtcagggtcttcccgagtccggtgcctgtatgtggcccagtttgagatctgtgtgtgtgctttggagacgccattgcttctgcccagcaccagggctgcctggttccctgctggctcgggaggtcagtctggaagcccaacccaccctcagcctgccccccagcctcagtctccccaagcctgcagtggggccggtgaggccgaggcgtcagaatttgtatcttcccctggatgggatccttcttatcttgcccgtccccgtttgcattcgaatgggcttccccctgctttctgctgactctagtccggcaggccacagggtgccagggttcggttccctcagctggccagggtcggaggcagccatgcccctggatggctcccctgacagcgccagccctctgcggctctcacacctctgtggggcagttcattcccttatcttgcaagtgctccccctcagcctggggagcagcctgcgagggctgggccagggggccatgctcctccctcctgccctctcctggactgagctgctctgcaggacctgagcggctgtcctcttctcacggaggcgcccggagcccgccgccccctcattctctgtgccgcacattcggtgctgacaggctgtgcaccggccttgcctctccctggccctcaccttctccctgctctgctgacctcatatgggatctgctctcgcctggagcaggggcgcggtgtccacattcctgcggtgggggtgccagtgtgaggcctggcccgctgtccccacctgagctgggcccctcctgccctgtaattagtggccggctgggcggaggcagcttctcaggtgccgcccacctctgccccaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggtacgggcaggcggactgggcgtcctcccggagacccggagccgggctgctggctcagcacatgggtccgatctgcgcccgcttctccgtgcagggcgcagaggaagcgtgagcgaggggcccgctgcctgcggcgcctgcctgcttacctccctcatcgtcctggccagcgtccttgggtgtctccatccgcccctgccgaggctctgggccaagtccacagggaaaggcctggttttccggagcccgccctcccgggaagctttccgagcagctgttgggctctgggctctgggggcgcccggtgctccctgcccatgctgagccgtgcaccgtgtggctgcgtgtgcgtctctctgcgcgtggtggtctgcccctgcgcccggcggctggacttctgggctttgcgggtgtgtgtctgcacgtgtctggccagtccctcctacgtgtgtcctgggtcctgttcatgtgtgttctgtgctttccgtgtgcacatgggatctgtccttggtcccaggtgtgcagcccaatctccttgtgggtcgactgcctgcatgtgccaggacagaccggcctcaggcccacagacgtggcagaaggaaggggccacagccctgcctgattctcttgcccccctaggccgaagtctgctcggggaccgtggccgacgtgctccagtcggtggtcagtggggctgatggctgcattttttcctttggccacatgagcctgggtaagcacccttgccccaccctagatgggtcctgctggccaccccctcccatcctcatcacggtggttgctggcagcttctgatgggaaaggaggctggtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtaggtgccacacccgcactcccgggcccctgtgggatgcgtgtcagcagagacccaggcacaggggcctgtcatccagtggctcctggggatgtccctggggttgtccccagcttgggcctggggtggggatgtggagcaggatctgggggcccctggctacaccatcatttgcttgccttgtggttccagtgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaaggtgctccccacctcctgcccgccccatctcggggccgtctcggctcctgtgtccactgcaggcctctgctggcctggttggggtgggggtcagcaggtggcctggagcctgggtagatgtcctatgtgttctgatgtcatgaggctatgcccatgtggccctccctggggggtggggagcccagcctgaggtccctggctgcagtgggcagaatcggggcttgctgtatgtggcttgtggtggcctcactccagcctgctgcccccgcacaggccctggggtgctcaggagagccgcaccacctctgcaggggcttcctagggacccctctctggggctggagggtggagtttggggcactctggggttacacggcccttggtgtgagtcctggccactggcctgggcacacatgcttgtcttttgagcttcccgttccctcccagcgcggggtgacaccgttttccttgtaaagttgctaagaatggtcacttaagttcttcccctgagactcagttccgctcccagcgtttggtgggacatggttggtggtgcctgctgtagttttcatcacagtgaccgcagcattggccctgtgctctggggagggtcggggaagcgggggcgtgtaggggagactgggctcggcagctccacttttcttcccccagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtgggtgcagaggtgcacagccctctacagtttacgggctttctgtgtgtagatgtgcacagccctctacagtttacagggccaggagatgctggacagatgggcacagccttcaaggtcccagacccacacagccgtggacggtttacagactcgcctggggctttttgtgtgtggaggtgcacggccctctgcagtttataaaccccctgtacttgcccttctctggccccaccctgccctggggggctgatcctggtctgtgtctgggtgagcacaagggcagccctgcacaggtcgccaggctggggcactggactcgggtttgggtcccgggcctcgtgcctccctggcgagtgtcgagctgcctggaaggcccccgccagggctgccccaagggacagaactgctcaggtcatggcagggaaagtgggaggccctggtggtggtgggggcgcccttgagagctgtgggcctggcttggggtcggcttcctccctgccctgggcagagcgccagcctgaggattcctggactggatcccgaaggcctccctgtcaggactcgggccggctccgcagcgtccccgcaggggctgtgcttgggctgggccccgcctctgttcaccctgtgcccggctctccgttccaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccaggtagggcctttggtgggctggggtctatgacccctggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcagggctgcttgggggtctctggggagagggtcccatgcctgagcccccgcccgccctgcctcccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacccgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttccca

SEQ ID NO: 1274 - DNA, 16019 bp, Homo sapiens
attgcattatttcttttatttttatgatttttttaataccaaaaaaaagagacaagattttgccatgttgccgaggctggtctcaaactcctgacctcaactgatcctcccgtctcggcctcccaaagtgctgggatgacaggcgtgagcactgccctgccttgtgcttttatttctaaacacattttcctaatgtatttttctgatgactctcaaggggaggatggctgttttggctgggtgtggtggtgcacacctgtagtcccagctactcaggaggctgagcggggaggatcgcttgagcccaggagtttgaggctgcagtgagctatgatggtgccactgttctccagcccaggcaacagagcaaggccctgtctctaaaaaaataaatattaaaaacaaaaacaaaaacaaaacaaaaacaaggaagagcaactgcatagctgcctgacaaaacgagagcgtggctcagccccacggccctgcgcggcctccctggaagcccctgtgctgtgccgggcactgggctccccatgcaggtgctgcgtctgcccggctctgtgctctgagtgcatgcgatgtgcccgaggtgtcggggcagggaggaggattgatctcgatggtgacccagtgaggtaggtgtcattggccccattttacagatagggaaaccagggcatcagtgtgacctggtctaggcaaggcctttgcggcagacccagatctgactcagccccgagggtgcagggagctggctttctccgccagacaagcaggccaactgctgcactcccccctcagtaaggggctaggggtggggaccccaccctgtacggacccctcaccagcatctccccgaggatgccgctggggactcctggcaccccttgcctctgctgtggctgtgtcacacctgtcctgccaactgttgttctgggcgtggacatttggggctccccgttgaggacgcctgggctgcgctctgggagccagcagctggccaccctgccccacggttccctagaggccctccagctcagcacagacccaaccccagatgagggcgcctgcccccttggaggtggtaggctgccctatgccctcctgggcgctgccacagtgctgggtgacctccagcatggtgctcactgacattctgaggcaggagcccagagggcccacaatgcaccaccgcatccaggcaacgcttgcagaaatgctccgcaaataaagtcatcgccactgatgcgaacagggcagccaccaggtacctctgccagcaggcgtgctacctgcccacagccaagggagccagccaggcaggctgctgatgaagaggccccactgcctgccacatgctctctgggctcccggaagcctggaggtgtcgctcctccccttggcatgcagccaccttccatgtgggaaagcctggggccagtggtcacggagggagtggcttcaggaacgagaaattggtagtttgtcttccagaggggacatgggcactgtggctggtgggctcagtgcacaggaaccacattgctggccccaggacccccaacctgccatccccctgccacacagtgggctcagcaggactcctcaatcagcctctttgcagggcatggtgaccctggtgggtgcacgggcctggagaaggtgtagtggtctgcaagggccacgggcgactgcagctcctcggtgtccctgctgtgggtgagcctggtgacgtctgtcttcatggaccactctttccaccccttatggattctggacacttcttggcgggaatggtccgtggccagcacgtagataatggggtcagccacgccgttcaccgtggacaggcacagaaacaccacagaggctgtgtacagcctttcctccaagccgcacatggcgttcctgtctcctctgtagtaggaaaaggcagcggctttgacgaggagaaccaggtggtacggggcgaagcagactaggaagatgacaaccaccgcgatggccgagtgcttcaccttggccttctgggcagcgcttaagcccatgctctgcttgatgctcctgaaaatccggtggttggtgaaggcgatgatggagagagggatggcaaagccaacggtgaacctggcgtagtagtacccggcaatcctgctgtccatctgcagcatgtcaaagcaggtctccttgtcttccgtctggaacaccgggtagtgaacgatcccgacgaggatgaagatgcaggcggagatgaggatggcggtcctccggcggcggcggccccgactctccagcgcgtacaccacggccacgaagcggtcgcaggagatgcagcacaggaagaggatgctgacgtagatgttgcagaagaagatgtaggcggtcaccttgcaggccagcaggcctagggtccagcggtgctggttgcggatatagatgacccagagtggcagcgtgcctgtgtacagcagctcgcagagtgccaggcagagcaggtagacggccagcacgttgccctgcagtacctgcagcagcgccagccacgcagtcaggcagttggccggcacccccagcgtgcacaccgcgctgtacaccacgaccaggactatcctgctctcttcgaaggacacgttgttgcaggtcttggcggagaggcccagggaggcccacggggcagtggtggtcactggggtggcgtttcctgtgggacagagacaagagtgaggacgggagtccctggaaaccacctgggagagactctactgtgggaagaaaggatagaagctttgtggtagctcagactagacacacgcaggtgtttaaaacatttccaaattgattttttagagcaattattagatagtggatctccaacctagcagcgtcatggacaaagaatgcaggctgggcaatactgaatcatttttcttttttcttttttttgaaatggagttttgctcttgtggcccaggttggagtgcagtggcacaacctcggctcactgcaacctctgcctcctgggttcaggcaattctcctgcctcagcctcccaagtagccaggattacaggcacgtgccaccatgcctggctaatttttgtattttagtagagacggggtttcaccatgttggccaggctggtctcgaattcctgatctcaggtgatccgcctgcatcagcttcccaaagtgctgggattacaggcgtgagccattgtgtctgggcaatgctgagtctttgtaactcactgaggttttcaaaaatgttgcttctggcccggcatggtggctcacacctgtaatcccagcattttgggaggctgaggcaggcagatcacttgaggtcaggcgtttgagaccagcctggccaacatggagaaaccctgtctctactaaaaatttaaaacaaatagttgggcgtgctggctcgcacctgtaatcccagctactctggaggctgaggcaggagaatcacttgaacccaggaggcggaggttgcagtgagctgagatcgtgccgctgtactccagcctgggcaacaagagtgagactccttctcaaaaaaaaaaaaaaagttgcttgtgtgtttgaaaagaatgttgatcctgtaattgctgtgtgagtgcttttctaagcagtctgttaggcgctgctactatgcccttccagcgctgacccactttgcctccacttcccacctggccccatagctgggcactgcctcatcctaattcctaacctgtagtctttttttttttttttttttttttggagatggagtctctccctctgctctgttgcccaggctggagtgcagtggcacgatctcagctcactgcaacctctgcctcccggattcaagggattctcctgcctcagcctcctgagtagctggcattacaggcatgcgtcaccacacccagctaattttgtatttttagtagagatggggtttctccatgttggtcaggcttatcttgaactcccgacctcaggtgatctgccctccttggcctcccaaagtgctgggattacaggcgtgagccactgcgcccggctaatctgtagtcttaccacatatttgcctgtgtgaactatcaattactaaaaaagataattataagctcctgtgggagtggtggatttgtccacctctccttgtattctcccagtgcttgctttacgtatttgaagctactgtgaattggggcataggagtcacagatggttctgtcttcttggtgaattgatcctcttattactatgtcatgtgatacccctcctctcggtggcaggagactaatgaccccacccaaaagatgtctgaatcctaatccttgggacatgtagatatggcaggttacacgggaaaggggaactaaggttgcaagttgaatgaaggttgctaactagctgacagtaaaataaagagattattctggactatctggtgggcccaatggaatcacaaaagtccttaaatgtgggagagggcaaaagaaaaggagatcaaagtgatctcagcaacctgcctcaaacacagctctccgaggtcagaaactcatcctttccagccagggggttgctagaggtcacgcagggtgtgcagtggtgtgacttccccaagctctgccagcgccaccagctccagtgtcctggctgcccactctggctgagttcatgcttctgggccttctgtggttacagatcatggagtcccacctccaggtcagcaggaagccgcagacagacctggcctcagcacctgacggacggacagagcgttgccaaacttattgggccacagcagccccgggcggggcaaacttcagctgtgccctggcgcgaggtcaggggtccctgggcactgtccagcccgctggcctcaggaaccttccacatgcaaatgtcgtagtttccttgacctccctcctgtacttgagggcctgttgacctccagcacgatggggcaagtcaccccgaacggggtcagccctgcggccccattgtgtcgctctttttttttcttttttttttttttgagacgtagtctcaaaaaactgtgttgatgcccaggctggagtgcagtggcgtgatctctgctactgcaacctctgcctcccaagttcaagtgattctcctgcctcagcctcccgagtagctgggactacaggcactcgccaccacgcccatctaatttttgtagttttagtagagacaaggtttcaccaggttggccaggctggtcttgaactcctgaccttgggtgatctgcccaccttggcctcccaaagtgctgggattacaggtgtgagccaccatgccaggccacttgtttttgtgcatttaaaaaattcagctgggcgcagtggctcacgcctgtaatcccagcactttgggaggccagggtggggagatcactagaggtcaggcgttcgagaccagcctggctaacctggtgaaaactcgtctctactaaaaatacaaaaattagacaggcgtggtggcaggtgcctgcagtcccagctacttgggaggctgaggcaggagaatggtgtgaacccggaaggcagagattgcgccactgcactccagccagggcaacagagcaagactccatctcaaaaaaaaaaaaaaaaaaaaaattcggccccatgggccgttcattccttcaatcccaacgctttggaaggacaaggcaggtggatcacccgaggtctggagttccagaccagcctgaccaacatggtgaaatcccatctctattaaaaatacaaatattagccaggcgtggtgggcacctgtaatcccagctacttgggaggctgatgcaggagaatcccttgaacctgggaggcagaagctgcagtgagccgagattgtgccactgcactccagcctgggcgatagagtgagactcaatcgcaagaaaaaaaaattgaaaaagtggaaaattgtggcaaaatacacataacaaggaatttaccattgtaaccgtttttcagtagcattgggcacattcacattcttctgcaaccatcgccagcatccgtcggcagaaccttctcatcttcccaaacggagactctgccccaggaagcactcgctccgcatttgctcccagcccccaggcctccattccactttgtctctgtgcgctgggctcccctgtcacctccccacgtgggtgggcatctctgcgtgtcttcagcgtgtgtccttccgtgtctcacgtgctccactcaccacagtgtcctcaagctccctcctgttgcagcgtgtgccaggatttcccttcctttcaaaggcgggatggtattccattgtattcagtgtgtcctccagggtctcgccaaaaatataaatatatatatatattccactgtgcccttccatcttgagcaatcctgcacgtgtggcgtgtggcgtgtggcgtgtggcgtgttctgctcagccacgactccgctgacagacgctcggctgcctctgtgccttagctgagctgctgagaatgacggtgtcaagaacatgaggagggctgttcacgtccctgctttccgttctcctgggtcagacccacagttggcattgctggatctcacggcagttccgtctcatctcgtggggtgcctccgcgctgttctccacggtggtggcgctggcccaccttcccccggcggtgtgcagggctccggtctccccacagcctcgctgcgcttgctgggtttctccgggtgagtgtcgtgtcccttgctcaccttcctccctgggcagagggagagagtgggtgtgactgggctgcctcacactcagttgtcaccacttcgcccaagacacaggcctgtggcgggcggcggggggcagtgaaggcagttctcgggtgggaggcccaacgcctgtgtttgcactcactgttcttcacccagatggctcttttcccatcaaacgagtgccccagccccgctgtgcgagtcctgagctcagaggaagtttcgggccccctacacggccccgtctctttcatgacaatcacaggccctgggaggcagagccagaatccaaaacacaaggggagatgcaggcaagacccggggtggccagaggggtccctcccacctcagcctgcacagagccgctctggtctgttccctccccgacttcctacggctcccccaccccacacatcgtcgcccgtgcggtctcagtcagggcctcggtgcccctcagtcccgcaccccctgctccaggcctcacgcagccttgggaccttcacctctggacaccaggtccgtggtgtctgtggctctgtgcccatctggtgaggaggctgtcccccgctcccccgcctcctgccacaagtgacctcctgggaagagagccttcctggtgggtcagaagtaggggcaacggcaccaggagacgcatggatgcggggggctggtggtcagctcctcatggcccagaccgtgcagggctcccctgggacctgtgggacagccccctgactcagtactgtgtcgccctcccaggagccaccaactatgccctcattcccgttcctggcttcccagaacttcacgaaagaattatgaaatcagtccttcatttctccatgtagcacctctagatttattattgctgagctagtttttatctcgataatctatttttatgcgttaatttttgaattatgagacaacatgcttcatggaaaaattctcatgggcttcctcttacatgttcaaagtcggagaaggctctctcacctggcatattttgcgggttccaatctcagtgtggctctaagataagctttctaagtacatgtcatgcgtcttgtcggtcctatcaagacgttcactctgagagtttaaaatgacctggaaaaagagtaggttgaaattgttttagggaaatcagattgagtcacaagttaacccattgacaaacggctagtgagtatttactaatttactaagtggcccgttgattcgtaggtgttttttaaatgttgagaatctgccgttgcatcccacatgagaaacacaagcaaggctccaagccaacaggcatcaaaacgtcacattagccactgcgactacatacgattcttttttttttttttttttttttttcttgagatggagtcttgctctgtcgcccaggctggagtgcagtagcacaatctcggctcactgcaacctctgcctcccgggttcaaactattctcctgcagcagcctcttgagtagctgggagtacagtcgcctgccaccacccccagctaatttttttttttttttttttgagacagagtcgcactctgttgcccaggctggagtgcaatggcatgatctcggctcactgcaacctccgcctcctgggttcaagcgattctcctgtcttagcctcccaagtagctgggactacacacacgcgccaccatccccagctagattttgtatttttagtagagacggggtctcaccatgttgggcaggctggtctcaaactcctgacctcaaatgatccacccacctcggcctcccaaagtgctgggattacaggcgtaagccaccgcacctggcctaggtactcttcttgtttgtcaattatacctttataaagctgggagagaaaagaaagttgatgagctttcacagaaaacataaaaatagctcctaaaggccaggtgtggtaactcatggctgtaaatcccagccctttgagaagctgaggtgggaggatagctggagtccaggagttcaagaccagcctgggcaatatagtaacaccccacacctacaaaaatataaacaggcatgatggtgcacacgtgtagtcccagctacccaggaggctgagttgggaggatcgcttgagcccaggaggtaggggttgcagtgagctgtgactgagctgctgcactccggcctggctacagagagagaccccgtctcaagaaaaaagaaaagctcctaaaatctgaaaaatgttcaactccacttctaatcaaagaaatgcaaacatgaatatctgaaagacagtcttttaaaatctttttttggcctatcatgttggcaaaaataaagaccttttaaactcatagtgtttgagagtaggcaatgggtgcccgtacacgggactgacggaagtatgaattggctcgcagcaaaattttgcaatatgtttccaaaaatctcaaatgtgctctacttttgacctggctgatccccttctaggaatttttcctggctacccgaggtgtgacgtgcacatggcctggaagctgtgtcacccacagcatgaggggcccggaggagggaggcatgatgggcgggcagcagatggctcagggcatgcaggggggtggcgcaaggcgcccaggggcctgtccctctgcttccttccctaacctgaggtgcctctaaaacaggcaccaccctgaccagccaaagagggtttgcagggaggagagcgccctaaacccatcctcagatggtgtttgtgcctctcccacagccctgcaaagcctgagggtctcgctctgctgtttccgggccctgcagtgcagggatagaggctgagcctggcggctgcctcactagctccaatcctgcctccctggtgccaggcccaacccccaccccatgctgcctggtgctgccctctatcagccgagaccctcatgggaagccagcaggtgcagtcagtctcccagtgcacactcccctcccagggcagggccggcccggctgcgggcagagcccctacacagcaaggcccctttgggcccgaggcctgtatgttgagaggctggccaggggcactccctggagccacttgctcttcccgcccatcccacgtggctcttgcaggaattctctggaagctgctcaaaagtgaggcagaacccagggacacccacaccaagggctctgggccagcaggtggggctgcctgtgtgttgacatccccagctgccctttcaagtatatttctgtgaaaggaaagtatcttgggccccttcaagctgggaactgctcagcgccgatctgcctggcgttctattcagtcatccctctgctcactgagacagatgcatattctgatgcctcctttggagagacttatcagaaactgaaaacaatgcaaccatttgtctctcgcctacctgtgtaggcgagagacaaatggttgggaagccccctccctgcttcgagttgtccccacctttctggacggaaccaatgtacgtctcacatatattgattgatgtctcttgtctccctaaaatgcatgaaaccaggctgcgcccgaccaccctgggcacgtcatcaggacttcctgaggctgtgtcacagacgcgtgtcctcaactttagcaaataaacctcctaaaatgattgagacttgtctcgacgttttttaacaactggaaaaacaggaagccacaatgttctcctgagattacaggaagcttgttaacttatggagaattttaaagcaataccttgaaaacacatgaaaaagtgagacactgagtcaagaaagaaacaagaaaagccatctccaaagtgatgcccccttggcggtgggtggtgtgggccggaggggttcctgggctacccattctgccaccaccctgccactggctggagtaagtatgcactgctccctgcatctcgggccagccccctgagtggagatggtggggcagcgctgagggtcttcagactctccctcgggtgcctgtgtgctgggcgctgccctcccagctgctgctctgccaagatccgtgtggccctgtcgtctggctgctgcgcccagctccaaggcccagcaagagatgcagggctctctggccatgcccaaaacagaggggtcagtaggtgaggaagcagtgagccggaaccaggagggccaaggaaggcagacccccagccaggcagggggcccaagtgggctgggggcatgtcagagccacctgagaccagtcctgttccttctgagccccgggggtgtggggggcccgaccagcctcacactgggcctggcttccctcctcagctgccgagtccccttcagtggccctagaagcccacatactcttgctcgctggtgtctactccgattctgcagccgccccctccccacctttcaaattctgaataacacgaggcagggacctctcctgtcaaatgagcaggagtgagcacatggagccactgcctgaggcccctgggccccatcagaacgcctgagccgcccaggaaggggctcccggggagtctgcctccttcactttaactggaccaagggttctggaaaccctcccaaacctgggaggatgaactcttgctggtccagggctgtgccgcccagtcacgccaatgccagccggcaaccctgggtcagagggctgcaagcacttctgcaaaaccaaaggaagtggcagctgcagtggaaatgcacgctcccctcccgggccccagccgcaggcagaggctcacagcgaggcccctctgggatccaggcctgtatgttgagagcagagactagccaggggcagagccggagccaccttcccatccagctggtcccatgcggcccatgcagcgtgagctgctgacgtccagatcccgccacgtgcctgacctttgggcaccacagcctggcgaggatgcctggaaagagtcagtgggcccagcaggaggcccggtgggaacaacccaaggcagggcagccggagagccgggtccactgggacgtcccgactccctcgcaccgaggtccagctcctcaccacgcatggccaaccaggcttgggcgccgggggagccctgcaccagccctttgcttatcagagcacatccaggctttgtctggcattccctgccggacaggcccacagcctcaggcagcccaccggcctcttccgagggccttcctggaccagggtccggggtcccgccagcacctgctcaccatccttttgccgcacctgctactcctactgcccctgggagcctctgcctcccctcggggtgagtgagctcaggataggggctcagggccctctctccggccagcccagtggccccacccgccagctgcagtgtcgcggtctgtcctggcccggggccagggctgtttcctccacagaaaggggcgtggggtacagcaggtcacccacatttcaggccctgctcttcctcggggagggtgcagtggggcccgggccctctctcagcttcccctggggctgggtcttcaagtggaaggacaaggccaggcagaggcttcctgtgttgttccactcaggaagcaggcaccaccctcctggggggggggagtccctcctgggctgtgcatggggaccgtcccttcctctcatcgccccagctgtctggcccaccagtggggctcctctcagctgtggggtgggtgggagtgactgagccctgtgggaaaggtccccggtgcagactttcacttctgaaacagcagcaaggtgctcccagcctgccggaggcttgggtaggggatagcccaccatgctcacagcaccagcaatgccagcctggcctggtggactccaggggactctgttcttgatctgctctgagggactatgacaggcagaggccccgctatcaccatccaactccaactggattcagggcagcgtggccagacatgatggccatggtgaggtccctcggatgactccagccacaagaccacagtgtgtgtgggcccaggtcagcctgacacccccgtccacccatccctgagctccagctgcatctcctgtccctgctggccctgggcccctgcctccacctcacatcagcaaatgaccaagcccctcatcacccagcctccatgctgggcaaatgtgtccctgtccagctccatcttcaagccacaccttggcagcccactgaggccagccctccactgctccctggacttctctctcctgtgtccaacccgcctttctcccactcagcgtgtcagctccgaggctgctctgcctcacactttccgtgcttcttccatgaacccatgttttctctttctttttttcttttgccttttttgccttttctttcttttctttcttttcttttcttttcttttttttttttttttttgagatggagtcttgctctgttgcccaggctggagtaaagtggcgcgatcttggctcactgcaacctctacctcccaggttcaagcaattctcctgcctcagcctcccgagtggttgggactacaggcacaccaccacgtccagctactttttttgtatttttagtagaaacagggttttgccatgttgcctaggcaggtcttgaactcctgggctccaatgatcctcctgcctcagcctcccaaagtgctgggattacggtgtgagccactacgcccagcttttttttctttaaatactattaaaattgttctctctctctctccctaaccctctccctctctctcttgctttatttgtttgtttgtttgtttatttatttatttggagacagggtcttgctccctcatccaggctggagtacagtggcaaaatctctgctcactgaaacctccacctcccaggctcacatcatcctcccttccgagtaactgggactacaggcacctgctgccatgcccagttaatttttgtacttttattcttagagacgaggtttccctatgttacccaggctggtctcgagctcctgggctcaagaaatccgccggcctcggtctccgaaagtgctgggaatacaggcgtgagccaccatgcccggccaatgaatccattttccagattagagaagcaccacatgttcctgggatggacatttcaataacaggatctagcatgacctcacccagccactgtccctggagctctctggcctgcaagttgctgtgctcctccagtcttttaaaatctattttgtaactttttttttttttttaggctgagtttctctctcgttgcccaggctggagtgcaatagcacgatcttggctcactgcaacctctgcctcccgggttcaagtgattctcctgcctcagcctctgaagtagctgggattagcaggcgcctgccaccatgcccggctaattttttgtatttttagtagagaaggggtttcgccatattggtcaggctggtcttgaactcctgacctcaggtgatccgcccgcctcggcctcctaaagtgctgggattacaggtgtgagccaccacgcccagcctgttttgtaacttatgatggaacttttcagacagacacaaaaggacagagaaggagccctggcccctgccatgtgcagggagcagttcctcattccagcccatttgtcaaaaacagctcctcaggctgctgaggtctgtcttgtggactatctgtaatttctttctttctttttttttttgagacagagtttcgctctcgttgcccaggctggagtgcaatggcacgatctcggctcaccacaacctccacctcctgggttcaagtgagtctcctgcctcagcctcccaagtaaatgggattacaggcgtgtgccaccacgcccggctaattttgtatttttagtagagacagggtttcaccatattggttacgctggtctcgaactcctgacctcaggtgatccacctgccttggcctcccaaagtgctgggattacaggcgtaagccaccgcacctggctggattgcctgtaatttctaagctgtttcacggttgctggccattcctagccatttccgtcttttactcccacctgctttggcaccaggcaaacctatgacctcttttctgccgtcacgtttgagacaaaccctagggagggaaatgtggagtcaccagctccaacctccctgctccaccacacccatccaaagcccattgtcaactttcttatttttcccaatttgatagtgttgcccaggctagagtgcaatggcgcgatctcggctcactgcaagctccgcctctcaggttcaagcgattctcctgcctcggcctcccaagtagctgggattacagacgtgtgccaacacgcccggctaatttttgtatttttagtagagacagggtatcaccatgttggtcaggctggtctcaaactcctgacctcaagtgatccgcccacctcggcctcccaaagtgctgggattacaggcatgaaccaccgtgcccagcccctatcctcatcttcttccaggagcctctgctctcccacctcggcctggccaatctcctgaaatatcattttgtgctcagcccaactggccagtcttcagtggtcagtcccagtcccttgcagtggtacagacccacgtcatgcacttgacagaaggtattgggccccccgccccgctgtgcctggtgcgccgaacgccactccaaaggccggtgacctgcccagctccaggatcttgtcacgtgactgggccaactgccactcaccgcagcacagcccccactgccctgcttttccctctgtgtaaccccacaagcagcacaggccccacagagagaagcccagcccttcagtgccccccgaccaatcacggaagcaagtggccaaggagagattccagggacaaagtccagccccctgactcacccccatctggaccagtagccagggaagccttttccagaagaaagtctccaggaaggtggcggtgacaaagatacaatggaaactgttgtccctctcccccaaatcctccggccccatcacatctgtggtcactgggggtcctgggttctctcgggagggaccccagattaagaaccctcaacaaagcctccatctttaccaacaaatcacctttgccttcagatccccctctgcccgcctccagctcccagcccccagccccatcccagagcctggccccccaggcccactccccagcacgcagagcccagcgacttacccagggccccgcctgcgtggctagcctcgcacccctccc

SEQ ID NO: 1275 - DNA, 8388 bp, Homo sapiens
gccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaaccccaggtccagagagtcacacagcctccagctagtcctgtagatgactcgctccgtccccagtccgtgcagctgggataagctgggccctggctctccagccaggtgacagctgggccctctacctcagcctgggactggcagccatgcctaatgccctgcagggcaggaaatctggcaccttcagccatgacctctgatgtctgcagggtcttacgctatctaccatgggaccagggggctacagccctactctgcaggggtctctcagcttgagccaacctggctggcggtcctcccaggttccattgcaggaggaggtggtgaggcgctctggggtctgtagtcctgggaggggacttggacaggctccaagtctgagatggggcctgcaagaggcagcgcctctgtgctctgagctgcccgtctgcctggagcatttaagggagcaaaggtcctctctggtgagggcagggagtgtggggagcagctgtccaagaacagccctggcacctcgttgcccagccacagcccaggattccatgtttcctctcattgaccagccacagcccaggattccatgtttcctcttctgagagttagtgggggagagcaaaggcccgatgctgggccctgaatccctggggacagtggggacacggtgggcaccctgaggtctcctctgtggggtggggggagcatcccccagagttcagctctggggtgggggcggcacccacccacctctgcaggaccccccagcgtggggggagttgggccgcagtgacttggcctgagtcccctgtccccacacttggtttatgctcctacccccaatcccccataacgcttggtctccagggcagactcagtccaggcccgactcctgtggtgttcctggcatttccgccccatgctgaggcaggccaggttctcaaagccctcagccctgacccgtgggaggacagcccagacgaaccccagaggcctggaggctgagctggctgctcctgggtggacagccgacccaccgagccctgggtcccagcgcccagcctggctgcagacactggcactcagcactgcccaggcccaggccccaaacctcggagacatccccatcccagccaggggccagccagctcctgccctggtggatgtctcagtcagaggctggccagccaggtgaccatgctgggcacagacccctccctgcacccggggagggcgcctctgtacttgtgaggcacccttcccccatggtggcacctggggcagcctgactgcttgctttgggggtaggagtggggatgggagcccacatcccacagggcccagatggcctggctcccagctccttgtggggtgaccactctgaggagataaggcgagtccctgcagcagaggacaaccccctctgccagcagtaggggtcccactctgccgccatctctgccctctccacgcctagcctctccagcaagggtactgctcagctgccccctctgacctgtggctctctggaggggctgccgtggggccaagacaggagcccagcccaggagggaagcagttatttataggccagcaataagaggaccaagcgacaaaagcagaaacagccctttcagacgcagtttcagttgtggttgaaacagggaactgagatgcaaatacctagatactcactgagtgggagaccctgaaaggggagacacagaaagccggggcatgtggctaggcacagacgcccgcccgcccctcgtgcttggcccaggctcagccctggggaccgccttaacagcagtccttccggcttggccagggggacaggacaggtgacatgtggccggctgcgggctccaacacccacacggcttgtcctcgtggaaagcacacccccaacatccagggcgtgacctcgggcatgagtggggggcttttgggggcttatgtgggtgtctgtgcaggggtgtccccagtgcccagctgcccaggcactgaggggcagttctgggcagagctggagctgctggtgatgccaggctgccctgtgcagatgctgaagcctctttggaaagcagcagtggcccccacatggccatgctccatgccgccccgccgcccgtgggacagagaggctggcacggtaggactggggggccccaggggggaggtggctgggatcaatggcctttcaagagctccgagccagagtggagaggtcacaagcagccttgagggggcctccaagcagaggtgccctgactggtgggcaagggaagcctccctgggctgctccagaccttccctttatgcccctgctggaggtgctggggacagccagttaccacgagccacagcattgcagagtgggctgcaggccccctgacccctgccaccaccctgggctgggggccttctctgtatcaccctcccctctcccttgtccaccctagtcccaccccagtggcagcccaggtccgggaagtcaagacggtctctgtctcagcactggaggggccatcgtggcccagccagaagtcaagccccgccctgtctggtgaccctgcgggtgctgccccatccagttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagtaagtgagcccatggaggcctgcgggggcaggtctcagtttggggctgctgcctgtgtttctgcccttggatctgcccgtgagataaggggggccctctaccagctcctccaggaaggtgcaggtcaccagggagggccacgaccatatgagctggagtgggggctggggacggggcaggcgtgtggtgctttttgcagcaaacagaggctgccacctgggggctctgacaggctggagaacactgcctgtgctgaggctcaccccctcagtccttccacccctgggggtaatgtcactgtcccctgccgcccctcatccttccctcccacccttctttccctgcggttggggtcctggaatcccaggactgccccggaggaacctgttgggccatcctgcacacatcccctggaaacgggagcttacctgcccctggcccaacctttcccttccaggccagctctggccaccaccaagggcttccacaccacgaggccaccccagaccccagactccacagctctgctctactctgcccggcttcaggagcagctgctccctgtgggcagtgcctcagggctgagtggggccaggaccccccagtctagcctgctctggaccaggcagcccctctcaggctccttcccaaattgctcctgggtgtcaccaccccagcagcatgctgggctcaggcccaccctgcccagtctgttttgttgcctataccttaaacccttaccctgcacacttggcctgggctcatcccgggggccacctgagcaacggttgctctggcttggcagtgggatggggcaggtgatgtgaggtgggctgggggctcccgcacccatactgagcccagtgtggctctccccacaggcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctggtgcgccccgccctggccccaccgcatcctggtgctggaaacacagcaagtcaggctgcctatctatgcaggcgtctcgggcaccaggcccgggggctcagcttggtggtagggtctagcatggaacagggattaggccgctcctttgggggctctaacagcagaggtgtcaaggagctgggcctctgggtgactaaacactcagactgtgcctggtgcagtttggctctcaccaagggtcatccagatacttgacctgaccttgagctgtgggcagtcataggtgggcctcctgaggaggacatgggtcctagtggggatgcggaggagagggcagcctgaggtcagctctcatggctggcctggccttgcagggagaggctcttctgcagaagctgcagcagctgctgggcaggaacatttccctggctgtggccaccagcagcccgacactggccaggacatccaccgacctgcaggttctggctgcccgaggtgggtacctgcaccatgctgggcaccactgccctagcgtcgggcatgggctgtctggctggcaccacaggacaaggaaaagaagtgagggtgggaaaggtgccctggacttccctaggacaccccaggagggcaggacccagggctctgaggtcctttgagtcagcttcacctgggcacagggctggttccacggatccaaaagtgccattttccacagggcagagcacaggtggcctcggagccctgctgagcccagcagctgacctgtgggtggaggctcaggctgggacctctggctgggcagtgagaggccatgggcagtcaccacaaaggcaggctctggagctgagctgcccagagggatcctgggccagtctatccctctgtgtcctcacctataaaatggggatgaggatagcagcagcttagtaggactgttgtgaggacatctgagtcaaccccactgtcaagagcttggggtcaggctcaccatgaagctagcacttagcaagacctagttcatcccattgcctgaactctccaccaggtgcccatgtacgacaggtgcccatggggcggctcaccaggggtgttttgcactccaaattctgggttgtggatggacggcacatatacatgggcagtgccaacatggactggcggtctctgacgcaggtgagtgccagggccctaacacaggaggcctgcctgaagcgtttccccgcctgcactcctggggacttggcctgacatctcagtgcatctggagaaagtcgtgtagtcctgtttacaattcactatggtagaaacaaccggagactggtctaataaatgatagaattctacacagccactgaattcatgctgtggaatcacattcaatgacatggaaagatgttcaagtcacattacccagggaagcatggagattacaaaatacaagcctttttaggaaaagcaatgcatgaaaaacgtgtcagaatggtcatggcaaaggcaaccatggttatcacttgacagtgggattaagaatgatcccattcttaatggcttgatgcattttctattgtttttgtaataaacgtgtattgctttgatcattggaatacaatgttcaaaaacacaggcacccgctgggcactcctcccaccagcacactctattacagattcctacaggcaatgcttcccgcaagtggggaccagtcgggcagggactgcacctgccccaacatccctggcctgggtggagtggggtggaggccccacagaggggtttttctcccacagcgcctgactttggtccctgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagtaagacgggttgagaaggagcccatcagaggcccctgttctcccctggctggccagacccacagggagccctctgggctggccctgcagacaccagcagcatcagctgggtcctcaggcagccagcaccatgggtggggctgtggccctggggtgagcagcaagcaggctggcatcagtaggctctgggctgtgcctggaggcaggcttagctccaggaggacagctggtcagcaccatccctgggaaacaggccgcctgggaggtggtgggaggacctggggccctgggagtctccagactgctgggcgaggccaaggggcttagctgggcactggagagggaggggaaccccacttgctctgcggggaaggaagggaagagtgaggggtgggcagatcctcctttatcagcccacgggggtgggggtggacagccctccagccagccgagggactggtctgtagtagaggctgtatcagaacaagggaagcctccctagatgggggtgggggtggcaccctgaagggagtggataaacttccctgtggccaggaactgtttctgggacgtcaatccagcctggagcccagggcagtccagctgcttccccactctctccgccaggcctcagagccagtccccaggacccctgttgagccgaccccttctttcctcatatttccaggcacctgggccccctccctccacaccacatggggcctcttaggtggtgcatggtggggtcacaagttcagaatgggctgggctggcagagccttcagggatttctctcccgtcacaggcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtaggtctgagtgggaggtgggcggcctgctctgctgacgggcagctcctgggcacgtcccctcctgctgggacccctatcgggcccggcttgtaagcagagccccgtccctccccaccccaaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggtgagcgcgatcagatcacggcgggcgggccccagggtggccaggcacgggcgagggaggcactggctttgtgaccggcgtggacacctcaggagggaggggctgctgctgaagggggacggggtctccatggagttccggggaccaggccacccgcctgtcacctggccccacagggccccagaacactgagtcaggacgcctgtccccaagtgatgaaggtggagttctaccgcgaccagctgtccctcccgcacctaagcgaggggcttccccggctggagtctgatgacagtggaggggccagctgccaaccgtccccaaacccgtagccgggcctggcgctgagcgggctgcagaggggcctgtgggagccggcgccccagtgtctcctccatcctccccgcaggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttc

SEQ ID NO: 1276 - DNA, 50873 bp, Homo sapiens
cgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggaggtaaggccgcaccgcctttatgcccggccccgacccgcccgcagcccccacccgccgccgctgccgcctcccccgcccctctgccccgcaggccccgcgccccccgcccgccctcgcggcccccggctccttcccgaaccgccccccgccgtgctcaccccaacccaaaatggccccgcgggtcggccccatcgggggcgggcggggctcggcggcccgggggtggggggcggcccacctgttggggccgagggggcggccgcgggggtggcgggggggcgcggggcctgcgggacatccgggggtccggggccgggagcccccagcgggagcacgtggccttgggaggcgccggctgccggtctgggagcaggagttttggggctgtggggtctcccccggcccgcggccctgtgctgggactccggtgcatcccctctggggatggggagccccggtgaggggccacgttcctccctagagccctcctgcagcctggccccggggcttcccccagcagggatccctcagggggtcttcagcagggagcgagcatcccgagcacgcctctaagtccccccaaacttttccctgcctctcgctcacctcagcccattcgggaggcgctttgcaagggttggggagaggccggagggcctcctgggcaggggcttcctccgtgggcccagcctcctgttgctcgggccccccgggcctgcagctttgagccttgccctccttcgtgtgcctgggactccgtggggtctttcacaggaaggtggggggtcgtgtgcattccatcattccatcagcgcctccctccccaggactctgagacccctccctgcctgtgaccctctcgggcaggtgctcattacctttcccacctgcagcctgcgctgctggagggagctggggtcactcccgctctggcttgatccccatgcccctgaccccgagtgcccagaacactctgtgtctctcgagcgtggcttctgctgccttggacgccgtgtggtctggccggccagtcctgtgaccttggggacggtgggagccccctacatcccgtctgtgagatgggcggtcagtccgcatcagcagctctgggcctcccctgtcctctcagaggggcggtgggcctgtaccccatccagcggcagcccctcccacagcctcatacagctttgccaggtccctgtgtggacccaggtgcgctgagcccaccccacgctcagggagcagcctgggtgcggggtccctcgagggaggggcctgttccttcctgttctttctccccacctggagaccccccttccagcctgacatgagggcccagtttctcaccctggcagagaggatgcctgctgcctgggctccagccgggcccactgcgcatggttttgggattggtcccaagaagagctctccctgcccccacccatgttgggggtggggagtggtggcagctttgggctctagggctggggacaccccgaccccaactcatgccttcctagtggctgcattgctcggccttcaggcctgcctgcctgtgatcttggcgccagcctggctgccccccctccaaccttcccatgcctcggtttccccatggtgtgggtgaggacctcgtctctcagccgtccttttgtgccctgtggcagctgtgctgtggctgatgaaagccaggaccctgccttgtcccatcccggaggtgcagctcccctgggccccacacaggcttgggaggagcccttcgtggggctgcgccgccctccccgaaccctctgtccccctgtgcccgcaggcccgtcccagggcctcactgacccacgcactccagtgctgtgagggtgggtggcctggactcctaggctgtggcggaggggccccaccatgcctggcagagatgctgctggtctcttttcctgtgatgaggagcatgggaggttgggtgctgtctgctggcagcacagccacgcgtgggatccagactgcttctgcgtgtgcagtccgtggtcactgtggccgggtgtgctcggagctgtcaggccccccacgtgcccgccccgaggacttcctctccctgcaggtgagactgtaggcctccccctctctactctgactgtccctataggagaagcggcatttatccctggcttctggaccggaaccctgggttccggcaggaccccggcagagccctgtggtcgcagtgggctgggcattgcaggttggcttcctgtcttggtgctcgctcggggaggtgggcgtctggattcttgagcccccagacaagaaagaggaaggtgtgcagtgtctcctgagcagcctttgtccgtctgtcgccggctgcctggcacgggctccatctgggtggccagtcctggcctgtgggagatgccggcagggacccagcctgggaaggggcttgctcctgtgcccccccaccccagggaccttgtgtgtagaggcaccaaatttagttaagaaaagtacaggacgcccaggcaaatttgagtttcagataaacagaaatttattagtgtaagtatgtcccaaatatggcatgggacatacttgtcccagaagattcttatctgacattcacagttatctgggcaacccgtattttagctggcaggctactccgaggccctgccaggttgggctaggcagggtgaaggtgtggtggcagtatttttgtgccagctgagctgggtgaagtggtgagcagggagggaacagggcctgtttcttccccatggagtgccctggccacggacagaggccttctgtctgtgcctgtgagggcagcggatggcctgggcaagggtggcggggtcagggttccctgacctctgcttctcaagggttgtccatcccgagggctggggaaggcttgaaacctgctgtgggatgagagggccccagggcaacggcgggatgtttcttctctgggttgaacatgaagatgttagatagcatccaaaacaggacagcaggaatcggtgcctgccagccgcctgcagcttgctcatgtggggcttctgcttttcagtggacaggccattaccattttgccttgggtgtttctgtttttcattgcaagaggttaacaccccatcttttggattttttttgtttaattttttttttttttttttttttgagatggagtcttgctctgtggcccaagctggagtgcagaggcgcgatttcggctcactgcaacctccgcctccccggcccaagcgatttcctgcctcagcctcccaagtagctgggactagccaggcgccaccaggcctggttaagttttacatttttagtagagacggcgtttctccatgttggtcaggctggtctggaactcctgacctcaagtgatccacccgcttcggcctccgaaagtgctgggattacaggcgtgagctcatgcccggcctttttgttttaattttaataaaagttgaggctgggtgacagagtgagactccgtatcaaaaaaaaaaaattttaatgtagtttgaaaggatgccagaaagcccctgcccctgcagggccgcgggctctgccccggtctctggcgcagcctgggcggaagcaccctgtccgtgctgctggtcttcactgggcttggcatgtgccatcatctgcgctctggcgcgctgttagaaatgttgcttttgtatttttattctagtgtttttttgaagtttaaactttattgctctatatacttgccagtggggaaaaaagtaaacttaaaaaaaatgtcagatttgtagagggctgcagccagcgccgccctaccctggagtgctgagtgcaccgtgtccctaggcacttgctgctccatgggccgacttttggggtcccacccatcttttccaagaaggcagggaagagccctggagacacggccgtcctgtgagcaccaggagcgggagtggtagaagtggcaggggcccaggtgtgatgtcctggaggggatggcatggggctgtcccacttggcctgtgaggatcggcctcagcactgcgccattggcagccctggctcactctccaggcaggatgggccactgagcttctcctgcctcagccactgagcactcctggcttgctccacctttgtttttttgagacggagtctcgctctgtcccccaggctggagtgcagtagcgcaatctgggctcactgcaagtccgcctcccgggttcacaccattctcctgcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattgggattacaggcgtgagccactgcgtctggcttttttttttgtttttgagacagtctcactctgtcacccaggctggagtgcagtggcacaatcgcggctcactgcaacctccgcctcctgggttctagtgatttgcctgcctcagccccctgagtagctgggattacaggtgtgcaccaccacacctggctagtttttgtgtttttagtagagacagggtttcaccatctaggccaggctggtctcgaactcctgacctcaagtgatccacccgcctcggcctcccaaagtgctgggattacaggcgtgagccacggtgcctggccccatattgttctgagtggagaatttgatcgttaagctctcagaataataaaaaagtagctgtcagtgagagatgttggaatatatggtccaatgaagcacatccctcgcgcccgacccgccctggcagtgccgttcccgcccgtgtgtgtgggttctgggtgtcaaaactgctgcagtggccctgcaggcatcctacctagaggtgggtccccagctgcgcatctggacgctggtcagcaggtgaggctgggatgccagaggaggtgccgtgtgcctggccaggtacccgggaggcggcttgggggagcactggctgcagggcctccttcctcctcctgctgaacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggctggagtgcagtggcaccatcacagctactgcagcctccaccccacaggctcaggcgatcctcccatctcagcttcctgagtagctgagaccacaggtgcacaccaccatacccagctaattttaagattttttatagaggcggagtctcactatgttgcccaggctggtctcgaactcccgtcctcaagcgatcctcttgccttgggctcccaaagtgccgctgggtttgcaaggctgtgaactaccatgcccggcagagcatttaatattctccaaatgtctttcctcgtgtgctacctgggctcactgctttctggggctctcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgcccccggcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagagcgagacttcgtctcacaaaaaaaaaaaaaaaaaaaaagagcctcaaggcctgtgcagttggtcagcggtggagtcaggtatggggcacacctgattctgccctggctcatcccctgccttcagaggacagcaagggcgcagcgcacgtgggggctggccctgaggtgtggcgttctctgggctgggctagggcagttctgagggaggggcgtgttctgtcccattcctccaggagacacagtgcctgggccatctggccacttgcatgagggaacgtctgtctgcatcccctgggggccgctgtccccatcccttgactgccggatgcacctcggatgctggggctctggtctccgatccttcttggactttgtggggacagcaacggaggaggatgaccccaaggatgggccgggcgcgaggcttgcagcagtgcccaggttttgcagataaaaatacaggacacccctgcagcatttgggacgttgtcacatggagacccggctcctggagcaggggtgctgggggctttcctgaccactgttgctgtttctcttgactctgttcccaaaagggaaaagacaaagttcctctctgtgctccctggtctcctgtctctgaccatggcagacctggctgtgggtgagctcaggagagtgggctgtgccctggagggtcccggacaggcagggaccacgggcaccgccctgccgcacagctcttgttgctcaatgatcttgggggttgtgtctgttctcccccaattcttctgtggccccatcccctatttgttaaaacttacgtgtaaccccaaaattcacacttatgtcactttcccagtcatttgcgggcacgcacaggctgctaaaagcccaagttgcgtggtgcttgggtgcctgctggggtgagcgaggcaccctgccctctgccactgctcccatgttggaagcaaattgtcctttctccatctactgagggccatgcttcttgcatttgggggctcttggtgattttgctttttagatgcccctgggggaggtgccgcagtgctgttgagtgtccctggacacaggcaggctgggatgggtcccatggagagaacgtgtgttggacaggctctgccccacgtgagttcagtgtcggagaacaataataattataaagttctttgacagaaacgtaaaataaggctgttgcgtattgattggttgctgaaaatgttgtgaccagaggctcgtaggaacctgaccctgtatttcctgtaggaacagaggtacggtgttcagtattagtggtgactttatggaacgtaattactgcaaacaatgagaattgactctgggtgcgtgtatatttttttaacttaaagtaaggtttaggccgggcatggtggctcacacctgtaatcccaacactttgggaggctgaggtgggcagatcacttgagctcaggagtttgagaccaacctgaccacacagcaaaaccccatctctactaaaaatacaaaaaaagccaggcgtggtggtgcgtgcctgtaatcctagctacttgggaggccgaggcatgagaatcacttgcgtgcaggacgcagaggttgcagtgagtggagatcgcaccactgtaccccagcctgggcaacagagtgagactctctcaaaaaaaaaaaaaaaaaaagttaggtttattgagatacacgtttcacatggcaaacccacttatgtgtaggggcctgtggttttccactcatgcacagctgtgtggtcgctgcagctcttccacacctgacatgcttctcttgtgaccttctgtagtcagccccctcttctcccccagctcccagcaacactgacctattttctgttcctgccgttttgccttgtccagaatgtggtagaagtggaattgcacagcatgtgggcttttgagtctggcgtctttctttttttttgagataaggtctcagtctgtcacccaggttggagtgcagtggtacagccatgactcactgcagcctccacctcccaggctcaagtgatccttccacctcagcctcctgaacagccgggaccacaggtgtgcaccaccacacccagctaagtttttcgttatgttgtctaggctggtctcgaactcctgggctcaagcgatcctcccacttcggactcccatagtgctgaggtaacaggagtgagccaccatgcccagccttatagtaattcttgaaatcaagtagtaggaatccttgaactttgttcctcattttcaaaattgtttagcctgttctggttacttggctttcccttacagagtttagaattggcttgttaatttctacagaaaccaaaaagaagtgtttcttttttttttttctttttttgagacaacatcttgctctgttgcccaggctggagtgcagtggtatgatcttggctcactgtatgtagcctcagtctcttgggctcaagtgatcctccccacttcagcctcccgagtagctaggactacaggcatacgccaccatgcctggctagttttatttatttttgtagagatggggtctcactatgttgcccacactagtctcaaacccctggcctcaagtgatcctcctgccttgactcccaaaatgctgggattacaggcatgagccattgtgcccagcctcaccttgcacttttatgtggtagaaatggcttctttccttgaacttcatgggccaacttctgctagcttcagatttttcttctgcagcctcctcacctccctcagccttcgtagaactgaagggagttagggcctcgctcaggctggggctctggcttcggggaatgtgtccgctttgatttcccatcccggcacttcagctttctctctatcagtactaaggccgttcagctgtcttatcaggcttgtgttcactggagcagcactttttgttttttggagatgaagtcttgctctgtcgcccaggctggagtgcggtggcacgatctcggctcgctgcaacctccgcctcccgggttcaagcgattctcctgcctcagcctcccaagtggctgggactacaggcacccaccaccacacccggctaatttttttttttttttttgagacagagtctccctctgtcacccaggctggagtgcagtggcacgatctcggctcactgcaagctccgcctcccaggttcacgccattctcttgcctcagcctcccgagtagctgggactacaggtgcccgccactatgcccggctaattttttgtatttttttagtagagacggggtttcaccatgttagccaggatggcctcaatctcctgaccttgtgatccacctgcctcagcctcccgaagtgctgggattacagacgtgagccactgcgcccggcctttttttttttttttttttttggtgaccaagtctcgctctgtcattcaggctggagtgcagtggtgcgatcttggctcactgccacctccagctctcgggttcaagtgattctcccacctcagcctcccgagtagctgggattacaggcacacaccaccatgcctggctaatttttttatttttagtagagatggggtttcaccatgttggccaggctggtctcaaactcctgacctcaagtgatccacctgctttggcctcccaaagtgctgggaatacaggtgtgagccactgcgcccgacccacttttagtttctttcaggaacttttcctctgcattcacaactgggctacctgcttggcgctgaagaccaggctttccgttagggtatcttggctttcgacaggccttcctaactaagcttagtcatttatttccagcttttgttttaaagtgagagatgtgtgaccctcaactcttcccttcactggactacttagaggccatggcagggttgctagttggcccaatttcagtattgttgtgtctcagggaatagagaggccccaggagagggagagaaatggaggaatggccagttcctggggcagtcggaacacacacatttatcaattaagttcttagttggggtatggctcatgatgcccaaaacaattacaatagtagcatcgaggagcaatgaccacagatcgccatcacagatagaatcatggttaaaaagttggaaatgttgagagaattaccaaaacgtgacagcaacacgtagtgagcacctgctgttggaaaaatggcaccgatggacttgacttgatgcacgttgccacaaaccttcaatttgtaagaaacacaatacctgcaaagcatcatcaagctaagcatgatgcccgtgtagatgtttgggaaataattggcatctaaaccaatcttgggtcctctcgtacagggattggcaaactggcccgctgcctgtttttgatgactcacgagctaagaatgggttttacattttttaattgttgagaaaaaaatcaaaggcagaaaacttcatgacacatgaagattatatgaaattcacatttcagtgctcagaaataaagtgttatgggaacacggccgcactaatgggagggattccagttattatgtggctgctttgagctaccgtggtggggttgaatatttgtgatagggacaggaaaaacttaactttttcccagtctcacacgttcaacacagaacacttcacctctggtccctggaatgtgtgtggggtttctccctaccagcagccagtcggttatccagtgatttaacccaattttgacactgcttacctggagagaatattaggttctgcagctgaagggctgagtcccacaagactgtcctcacttctcctgcctcagcctcccgagtagctgggattacaggcgcccaccaccacgcacagttaatttttgtatttttagtagagaccaggtttcaccatattggccaggctggtctcaaactcctgacctcaggtgatccacccaccttggcctcccaaactgctgggatttacaggcatgagccactgtgcccagcctacaagctggttattaacaagaccaataaactgaaatctatagccagactgacaaagaaatagaagccacaagtaaccaacatcaggaacaacagatgggacatcactacagatcctactgacacgagaaatgtgtggcacagaaaagggcttggttggacaaatttacaagggttgttaaacatacaaagtgccaaaagcctatagttattcattctattacttgttggcaggtaaatattttgtggaaagtatttgtttatttttatttttactttttgaggtggagtctcgccctgttgcccaggcagcagtgcagtggcgcagtctcggctcactacaacctctgcctcccgggcccgagtgattctcctgcttcagcctcccaagtagctgggactaaaggcatgcaccaccacacctggctattttttgtatctttagtagagatggggtttcaccatgttgggcaggctggtctcaaactcctgacctcaggtgatccgcccacctcagcctcccaaagtgctgggattacaggcgtgaggcactacacccggcctgtggaaagtatttgagtctgtcatgccttattgaaccagtagtgtcaacagtgaacttcatttgaccttgtggacttgatgtcatcagttctgtgaattaaaaaaaaaccttttttaaagagatagagtcttgctttattgcccaggctagagagcagtggcacagtcctggcccactgcagcctcaatttcctgggctcaggtgtgagcccctgtgcctggcctaaagctgaacatcttgacttgctgtcctgtgcagcagcttgatgagttggcagtggtgaagttctattgcttttttatttttattttttatttatttatttatttttgagacggagtcttgctctgtcacccaggctggagtgcagtggcgtgatctcggctcaccgcaacctctgcctcctgggttcaagcaattatcctgcctcagcctcccaagtagctgggattacaggcacatgccaccatgcccggctaatttttgtatttttagtggagatgaggtttcaccatgttggccaggctggtctcaaactcctgacctcatgatccacctgcctcggcctcccaaagtgctgggattacaggcgtgagccaccgtgtctggcctgctttttgaaaaagcgccgaaattggaaaatttcagaatgagaagaaccactgttgactgccatcatcaatacaccagatgacttgggaaactagtttttgctgcatgatgttctctacgttctttatgaattcatcttaaagttacgaggcacaaccacatttatttgcaaaatttatactgtgatgaagtcactttggcaacagctcatgtttaaatcacaaactgctttgtacagttttcttattgtcaagaggtaaaatgagaggcaaagtctgcattgccacacagatttgcagtgagctgcttttctgggctcacactgtggttacagcagagtgtctgcgacttccatgcgagtgcaagggaaacgtcgacatttcaaaatccactcagctgtgtgttagggagctcccgcctgagcttcagtcgaaagcgattggactgtagcgtaaccccgtgctgtaatataggggccccaagaccaccctcgggttcagtaattcactaggactcatggaatacagcagagcatttctgccaggggtacggttgattacagcaaaaggacgcagactcaaatcagcaaagggaagcggcacaggggccgggctcaggagagaccaggggtgggcttccggcgtctctcccagcagagacgtgggcggtgtgtaggtctagcagtggtctgtgatgacaggcctggcgtatttccaagcagggacgctcccgtgagccttggtggtccaggtgtttttagaggttggtcaggtgggcctggctgagcaccggtgtggctgccctcggtccctccgtctcagcccctccagaggtcaggctgatgccacaaggcaccgcggtacgtcactgtcagggtagcctctctgaggtggcctgaggccctgggtgagcagacgctgttggcaggcaggatgctccaagagctccgaggtgacctcctaggagcaggtcaagggtcagacctctctggaaggaagaatgcgggcaatccaagcctgctgagctggccctttccaggaaagggagtagcgaggctgctcacttagagccacgcacctggggctgacagtgtgcctggcagtacctgtgtggaaagacagttacagaggaaacacatgaactcactataagccagcactaatggatgcacctttgttgttgattttggtgataaagaacattaaatttgaacccagtgaagcaatatgtcatctcccaaaacaagtcctctcatgagtgcatctgtattatagaaagctgcactcagctttttaaaaaaatttttttagatggggtcttgctctgtcaccaggctggagtgcagtggcacaatctcggctcactgcaagctccgcctcccaggttcaagcgattcccctgcctcagcctcccacgtagctgggactacaggtgcgtgccaccacacctggctaattttttgtatttcagtagagacaggctttcaccatgttggccaggatggtctcgatctcctgaagtgatctgcccgcctcctgaagtgctggcattacaggtgtgagccactgcgcctggcccagttattttgatttcatcagtatgaaatgtgtagaaattgttacattagtccctatgtaatatccttggtgtggcctcttggcctgcacagcctggagtattgactatctggacctttataggaagctcaccaacatgtattttaacccttgacaccttatctgttaccatttatttagatctttgctgatttttctcaccagtgttttgtacttttcagcatgtagatctttgcacagatcttttgatctttaaacatctatagatcttttgtaaaatttatattgtaagtatttaatttttcttggtgctcttgtgaatagtacttttacaattttgatttccatttgttagtagtacgtagaaagaggactttttttttttttttttttttgagacagagtttcactcttgttacccaggctggagtgcagtgaatggcgtgatctcagctcaccgcaacctccgcctcccgggttcaagcgattgtcctgcctcagcctcctgagtagctgggattacgggcatacaccaccacacccagctattttttttgtatttttagtggagatggggtagctccatattggtcaggctggtcttgaactcccaacctcaggtgatccgcccgcctcagcctcccaaagtgctgggattacaggcgtgagccaccatgcccagcccaaaagaggacttatttttatatattgacctgtgaccttgcaaaactcttactcagcagtttcaatagctttttttgtagactctggggatttctatatagaaagtcacatcatctgcgtatagaaagttttatttcttcatatccagtctgtgtgcctttcattgatttttcttcccattgtactggctgggacttcctcgatggtcagcagtagtggtgagagtagctatacccttggcacatccctgatctcagcagaagcagcccttttctcaccactgaggatgatgctagctgtaggttttttgtaaatgtattaccaggctgaggaagtaccctttagttccttgtttgctcagagtttaatagcgtatgtgttggattttttcagattatattcttgcatctacggagatggtcatagggcttttcttacttattctgtgaatatgatgagctacactggtttttgaatgtttttaaaaatttaagttatatttagagatggcatctcactctgtcacccaggcttgagtgcagtggtaccatcatggctcactgcagccccaaactcctgggcttaagcgatccttctgccttagcccccaagcagctgggactacaggcacatgctaccacacctgcataattaaaaataatttttttttagagatggggtcctgtgatgttgcctaagctggtctcaaactcctggactgaagcaatcctcctgatttcttgtgtgtctttggttttggtatcagggcaatggcgttctcactgtcagctggggagtgttccctccttttctgttttctggaagagttgtgtagaattggtgttaatttttccttaaatgtttgatagacttcaccaatgaagccatctgggcgcagagttcttgttgttgtatttccgtagtatggatagggttacctgtttcttcttgaatgagctttggtgtttatatctttcaagcaattggttcatttcatttaagttgtcaagttctgtggcataaagtcctccataatactccttacaccccttctcgtgtcagtaggatccgtagtgatgtcccatctgtcgttcctgatgttggttacttgtggcttctctctttgtttctttgtcagtctggctatagatttcagtttattgatcttgttaataaccagcttgtaggctgggcatggtggctcatgcctgtaatctcagcactttgggagactgaggcaggtggatcacctgaggtcaggagtttgagaccagcctggccaacatggtgaaaccccgtctctactaaaaatacaaaaattaactgggcgtggtggtaggctcctgtaatcccagctactcgggaggttgaggcagaagaatcacttgaacccgggaggcggaggttgcagtgagctgagatcgctccattgcactccatccagcctgggcaacaagagcgaaacttcatctcaaacaagcaaacactcagcttttggttcctctgatattttcccctctactatttttgtttcatgttatttttactctatcatttcctgccttcttgctttatttgtccgtttattaaggcataatttacattcagtacaattccttttacgtgtacagttccgtgaattttggaagtccatagtcatgttgttgtaccacagtcatgatacagaatagttcccaaattcccaaattctcacgtcttccacatcttggttttcctgcgccagcagcttgtaggtggccccactgcacgcagccgtcgtgcctgccacctcccccgagagggccttccggtgctgcagaccccgagctgccagggggcttcactcctggcccctgccgaggagtcttccatcaagtggatggaccccagcttgtttgtctttcctcacttaagggacatttttcccccattttttggcaagtttgatgcattgttttgaatttaatttatttggtttcttggagtaaaaagttagaccgttgatttgagaccttttttaaaaaaaagtttgagatatctacatgtgatgaaacccaccaattttgagtgtgtgattcagtgaattctagcgttttcacagcgttgcacaagcgtggacacatcctgcattcagaacactcctgtagccgtgacacagacccacaggccccctgtcacttctgcaggcttttctgcagggaacgctcactgctgtgcgtgtcccccgggcaccgtggctgtgtcccctctgggctctccatgctcctagcccgttgtcctgtggagctctatgtgggcgtagcctcatctgatcagctggtttgctcaggcagcacggggggctcaggagctgcatgcacaggtgtgactttgcacatgggtgcccaaacaggtgcgtcctcccaggtgtgcacccacagatgtgtcctcacgggcgtgtgcctgcaggtgtgtcctcacgggtgtgtcctcatgggcatgtgcctgcaggtgcgtcctcatgggcgtgtgcctgcaggtgcgtcctcatgggagtgtcctcatgggtgtgtggctgcaggtgcgtcctcaggggtgtgtcctcatgggagtgtcctcatgggcgtgtgactgcaggtgcatcctcaggggtgtgtcctcacgggcatgagcctgcaggtgcgtcctcatgggtgtgtcctcacgggcacgagcctgcaggtgcgtcctcactggcgtgtcctcaggggcatgagcctgcaggtgtgtgccagcagcaggagggagatgctctccaggcccctccacagggtcctcgcggcacgggtttggcctccgtgtggacagatgggctgggcttctttggtgctggtcttgctgtattttgctgaatcccaggcctgtgcgggcctctgggctgattccagctgagacaggcctcctgctcagtcccccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgcagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctacgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcatggctggaagcaccctccctggtcactcaggcagccctgcagggctgtgagctctgcccccaaccctgaggtgtctgcgtggctggaagcgccctccctggtcactcaggcagcccttgctcccacctggtttgtgtctgccatgagtccttggcagttgcttgctgtttggtcgggggacgtggttgtgcccatgcattgagcctggcagcaccagatccttcctggggggtggtgacacatgggcccctcagccccagccactcctggcctccactgcctcggcacagcctccgtcccatcagctcgggagacagagccgtagatggccatggaggtgtagggcgcccgcacaccctgggagccttctcgctgtcctcaggggtggtgggtgggtcccccagcgtcccttctcctcctcctggttggagactttctaagggtgttgagggagggcaggttgtccccaccagtggacacatggttccagcagagagtggggtggggtgctgggtgcttcacagacctctctgtgcctgcctgcagggctcctgagcccccgatcccctggagccagtggcccgatggctgccttctcctaggagccctgcccactcggcaggcctggggcactcgggcccttggtgttccatctggatgctgcaggctcacctgggagaagctgccttcctggacctcaggcttggtggcagcggtgacgtggggttcttgggatcagagggggcagcggggggaaggttagcgcgccacctctgacgtagccatgctgggctccgggcttccctggctgcgcttgtcgagggccattccctgcggtatctgccaccacctggggccgaggagcatggggtgcgacatctgctcccccgcagcttcctgggaggtctgagggccaggcctgtttgttggaggcacaggcaatgacctgggtgtcttctgagtctgcctcactgcccctgctgggcagggcctgcccgcctgcagagcaaggccacttgggtactgccggaatggggcgccactcctgtggctgagcctcctgagtgcggggcagcactttacgcatcccagcatgtggactgtagggaaacaggtgcagagggaggttcctcagctgacgctgaaccatggctgggggaggtcctgtgtccctcctggtctgtgtagtggaggggcggccggcagatggcactgctggccccacacagccagctggcaggcaacccggggcgggaggctgcagtgcctccgtgggcgcctggccgagtgccactgctgggaggtgccactgtcaggaaggttccctcgtgctgcttccggcttccatgtgcagacagtagattgcaggcgtgtgcaggcagggggctggcttccagcccttgggcgatgttcagttacacatgtagcattgcacacgctcagaggcgtccccttcgtcctaggactccctcctcctcagggccagggccacatggcgtgggcacttgcctgtctctgggcgggacaccagcctgtgaggggcacgactactctcttggactgttcaggcagggcagccgagccagacgctcaccatgtggaaaagaacccgcaggcctgcgacagagtgcggccagtgccctccacgccaaggagctccaggcggggcttccaggtgggcgcagctggttgagtacagacctcccctctgttccctggactgaacgccccctcaaataacaagaaagtggtgctggggctctgcacccacagggcaaggaaggtgggagaggcggtgccactgggaggtatgggcacagcttggaaggcagccaggcagactgggcaacctgagaggccctggccctggcctgggtcaggatggggagaacaggaaccatggtgacatgtggctggcagcgcggaaggcctgtctggggggtcaggtggtcccacagagcccttccctgggctggagcagtggactcagaggacccagatttggggcaccagacccaggccagcacagttcgtgcgggggctggaagtggggatcgcctggctcatggcctgtcccctggtgggcccccccgcccctcttgcctccttggctcccaggaccctagcggccagacttctaaagcccacagacccagctgctggcatcggggacccagcagaatgcccgctaccccagcacccatgggtgcagcccatgcagcgagctgcccagcaccggggaggctcccagggatgaaaagccgcaaggcgtatggggcggggcgggggggcttttaacaggaaggtcagccagcacatgtaaaaattgaactcagaggctggacgcaggggctcacgcctggaatcccagcactttgagaggccgaggcgggcggatcacaagatcaggagatcgagaccatcctggctaatacggtgaaactccgtctctactaaaaatacaaaaaattagccgggcgtggtggcgggcgcctgtgatcccagctactcgggaggctgaggcaggagaatggcgtgaacccgggaggtggagcttgcagtgagccgagatcccgccactacactccagcctgggcgacagagcgagactctgtctcaaaaaaataaaaaagtaaaaaaggaactcagaggaagggccagtgcagggaacagaaggaaactaaagcaaaacaaagcccgtgaatgttctctgagaaatggatgggatccatcctgggatgtggtcagatgagaggaaagctcttgacacttgggttaggagaagtagcaaatgaaatgaaaggatcaggtgataaagttgaggataccgcacagaagatggggcaaaaacacaaagaaactaggagagaaaaaaatcagacatcagtccattggtccaacgtccagttaatagcagagaaggagcgagcaaagcaataaagaggggccccttcaaggtgtatttaaaattttagaacacgggagaagaaatgtgtttagagaaaaagtgggtcacacacgaagcaccggagtcaaaacccactttgcctttcggcagccgcgttcaggtgtggaggctccacgcccagccaagctccatctcccggaaggcagatgagtgaggtttcctgactgaggccttggagtgcactcctccgcgcctttccaacacgagggaggcgcaggttcctcccgcccaggaagatgcggcccctggtgcaggcagcaagcagggtggaccccagctctgggaggggcctcgcaggcgccctgatatgagccctttctctttgggagctctgctgccgagcactttagggaagaatctgtgatgattccatgaaaaactaggcaagtggagaaaaaagacgattgttaatctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggggtggctgcggtcatgtgttcttgcagggttcatggctcgctgagacattggatggtctgtgtgtgtcactgtgatcagatgtggatgtaaccccactgcggtggagcctgtcagggacacaggagccaacaaagcgagaacccggcggccagggtagggacagctcgacctgcaggagggtcaggccacattggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttattctttcttttttgttgttgcttttttgaaacaaggtcttgctcttttgctcagaccagagtgcagtggcacgatctcaactcattgcagccttgacctcccaggcccaagtgatcctctcacctcagcctcccaagtagctgggactacaggcgcacaccactgcatctggttaatttttaaaacacattttatagagatgaggtttcaccatgttgcccaggctggtcttgaactcctgggagtgagccactgcccccaacccatttataacattaaaccaaattatctttaagaaaagtggccaggtgccttggcttactcctgtaatcctagcactctgggaggccaaggcgggcagattgctggagtccaggagttcaagattagcctgagcaatgtggtgaaaccccgtctctacaaaaaatttaaaaattagccaggttggctgggtgcggtggctcatgcctgtaatcccagcactttgggaggctgaggcgggtgggtcacgaggtcaggagatagagaccatcctggccaacatggtaaaaccccgtctctactaaaaatacaaaaatgagccggtgtggtggtgggtgcctatagttccagctactcaggaggctgaggcaggagaatcgcttgaacccgggaggtggaggttgcagtgagctgagatcgcaccactgccctccagcctgggcgacagagtgagactccatctaaaaaggccgggtgcggtggctcacgcctgtaaccccagcactttgagagaccaagacgggcggatcacgaggtcaggagatcgaggccatcctggctaacacggtgaaacccagtctctactaaaaaatacaaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtaattggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaagagttataaatagtattccattaggcacttgcactgtgattagaattacagcacaattcttgcagtagcaaagatgttataaaaactcgttcagaaaacatacgtgcttctctggtggcgttttacagccgtcttgacttggagacgtttgtcagccaggccaggtgggagggctggtcccatgcggggggtccaggctgcgtccgccgctagggccgtggctgctgtgcaggtcaccccagaggggctgggatagctgggcgtggcctcccaggagctgactgaggtcctacccagtgtggcgggggccttttcctccttgggaccctgctgttctcaggtggtacactggggtctggaagggagggagaatggagacacaggttgaggttgggtgcacacgcccgccttctcccctgggatagacgccacgggcgtccagagctgcaggatttgctccatttgtgaagtgccctcctggagtcccgaggggtggtgtggttacacctgcagtccctggacggcagggtccggccttggagcccctcctgggagctgtgcagcccgggtttggtcgcgtttctcagacgcccctgccttgctgttacagacggccaatgggaacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggtgaggtccagggactgtgggtttgcggtgggtcgggtgggaggaccctcgcatcttctgccccgtcccagcgctgtgggtgaggggcaggaagtcagcccaggcaacctccccctgctctgggaggggcttagggacaggacagaccatcctgccaccgatgccttgttcctgagcctttgctgggagtcggccagggcaggcgcttgtggaaggaaggtgtcccttaaccccactgccttgcccaccggacagctgggacctttcctcagcaaccagtggatgcggacgtgagctgccctgggtcagtgcagctgggccgggcccccgagcctgggtccactctggacactgggctgtggggcctgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagcggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgtgagctcatggcagccagggtgaggcccccagctgatcccagggacaggtgtgaggacactctgggaggcctctggctctcccacgtcactgcctccacccagcccctgctggggcgtccagcccacagtgcaggcctcagggtggagggtagacacccgccaggctgcactgtggcccctgtggcagagaagccctccccccggcagggctgtgagcatgaagcctttctcaggacagaatgacagggagaggggaacgtccctcctcagaggagggcgtgggggccctggagaccacagccaagagtgggagtgagggcacagcctgggcctcacgcttaggggtgtatccagggtctgagggagggttcagagtgtgaggggtgcagggtacactagccagccccacctcctgcctgggtgtttctgcctgttgagggtcttctgaggagctgtaggcccacctcgcccgcatctccgacaggctgcaccacagagccctgttctgctgaccgggacgctggtgaaatgggagtttcggagccgctgtgggctcctgtccaggctgggtcagtgctcggatggggcctggcatagggcgggcgtgaacaaaagccagcctctggtctggggctggtgtgtgggcctctgggccctggtgatgtctgagttcagggtgcagtttgctcgtgggtccccagaagtgggagcgagtgagatgtgttggcctgggatgagaggactggggctgtcctggtcggccctgccctgttctatggaccgggaggaggtgaggctcagccgccagacaccccaggcttttgaggcccagatagggccggcccagaacaggcccagcatggctgctcccagcctcagtcttagctgttggcgcctgggagggcccagaggagccaggacttcctgcaggcaccacaagggggccgcagagagcgagcagcccggctggctgtggtcccatctggggaccttgggctcagagagccggcagggcgctgagcgggatgagtggcccactggcggccggtgctgagcgtgcgaggggcggtggggagcaccactgcacgcccccattttgggtgttataagaaccctacttgggttcctagcacagggcaggaatccccatgctgctggccggtgcccggccccggtctcatctggacagcctgttctgggaagccccagtggagtgggggcaggggtggcctctggacaggggccctccacagccaggcttgtctgggctcttcccaaagaggcttggcactgggtggatgggcagccagagtggggggacgtcgaggcccagatgatcttcaaccgggtggtcttcacgccccaccgggaggcctgcggcccccgttctgccctgccccctggcggcacagccctcggtccgggccctgggcagggagcaggccgccaccctgtgctgaccgtgctgccgggtgctgtctgtctgttatatagccctgtcagtctgctataaggccggaccgggggcggacaacggcgaggaaggtaagagccggcctccgcaaggagggcgtcctcctgtctgtgtccctgggctgggggcggcagcgccgctgagggacagagtttgggcgggccgcctgcatgcctgtgccctgcgcccggccggcccggctgaggaggggccctcccttgtgtccggcccacggcccaggcttggtgcggccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtcacctgtgattatacggtgttaacctgccgtatagcatcccccaaggcgtgacaaccaaaaaatgtgtcccgacaatgccatacatccctggggagcagtgtcgcctgacggagagcggtggcactgaggctgctgtgagatccagcgaacgggagggttgggttttctgaggccacgtgggggcaaaagcgtctggagtgtgttggttccctggagtgcctgtcacagttgcggggcacacctgccaaggggcaggcgcatctccaggcctagggcttggcctcccacgggctctgctgccacctggctggagtcttgtgacctgaacacccccagcgtgtccagtcagctcagatgcaggttgctggatgcggcccccaccctgcccatcccaggggggctcatctctgtcgtggccatcggcgctctggcatgggctctgaaggatccaggatggccacggtgtgtcccaagctcagccctgcactacctctgtggccccggtccccattcccaccacacagcctggaaacaggcgtgaagggcgacagtggctcagctagggctgtggtcgtgccttagctcagagtcatgagcaggcagagaagagcaggcagggcttggcctggggtcgtaacacatgcgtggagcatgggcagggctcgaaccctctcaggctgccagaccagcttcccagaaggctgagccacaacatgctgggcgggagcagaggctgtgggggtcgctgtgaaggcttccactcaggaatgaggagtgcccttattgacagagccacacagagagggtgagactgcagaaatgtatctgtgggcacagaaaatgtttgttagcaaaaaaggcccgtgaggaagcagcaggtgcagtgacaagcctgtctgcactgtgtccgcccagaaacggccgggtccatgcttgccggggacaaaacaggctgctcaggcaccctgaaaccctcctgctgcacgatgcagcccttcccccctttttctttttctttttttgttttttttttttttttttttttttgagacagagtttcgctcttgttgcccaggctggagtacagtggcgcgatctcagctcactgcaacctccgcctcccgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgccggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaagagcgaaactctgcctcaaaaaaataaaaaggcaaataagtcatggtttttgggctgtagccgtatccaccctgccttggtaaaggcttgtggagcctggccccacccctgcagctgctcattggccctgcctctgctgaccctcggcatgtctcctccgtgcagtgtcatggggcaggtgcatcccccagtgaccctcgaggccccgctgtaggctcctcccaggcatggccgggagctgtgggggctcctgcgccctccctccctcctgcgcccatgtcgccccacaagagctctgggcaagaccctcccagcagcccggccgtgctgacgcctctctgaccctcccagcagcctgactgtgctgacgcctctctgtctcctgtggtgttttccaggatttcttcttctattctctagtctacgacccacagcagaagaccctgctggcagataaaggagagattcgagtaggaaaccggtaccaggcagacatcaccgacttgttaaaagaaggtagggtgggccgccctgggcatggagccctctgtcctgtcctgtcctgccgggtgacacactgggtgagaggaggctgggacatggccgtgtcagtgattcatgtgtgactgggggcggcaggtgtaggcctgggctctgtccacatgggtgatgcgtgtaggctggtgtcccggagccttcccccacccactcctggtggtgttggggttctggggaagcctcagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgctggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccctgcttgcagttgtgatcaaggcgtttcgtgcttgtcctgttttggtttgttttgagagcgggtcttgctgtgtcgcccaggctggacttgaagtcctaggccccagcgatcctcaagcctcagcctcccgagtagctggtgctgtttcgtgttcttcttgattgtccgtaaggtgctggtgcgtctcacaggtggctgggtgtgccacctcctccaggcagctgtgggctccagcattgggctcgtgggcctgctacattgcaagcatctgtgctctgggaggtgcttggcagtgggggaagacccccacatctctccaggcagacagggcacattgagggctgggcctggggaggaggcctctgtgctgaggcctgtgggtcggagcctggggaggccgctgtgctggagcccggcctgtgggtctaagtgtggggaagtcactgtgctgaggcctgtgggtctgagtgtggagaggccgctgtgctgaggcctgtgggtctgagtgtggagaggccactgtgctggggcccggcctgtgggtctgagcatggggaggccgctgtgctgggtctgggcctgtggcctccagggtgccctgctatcatgccagggtctcccagcctggggctgtcttgcctttctggcctggccaaaggtgaaggcctggcagccgcacccaggtggaaaggcagagtccgtggctgggagacaggtgagaacacagatcacatgagggccagagagtgaggagctgtctcaggtcagaggccctcagctggcgcatctgtaccttcagcctggggccagtgggcctgtcaggagaatgggccttgaggtgcccccatcttaccatgcacacctggagagacctggcggagctctgcagggtctggggcgatgggactaagggtccacaaggccgagccagccgcaggagccggcctcctctccccacgctgccttccccgctgccctgccgttccttggcttttgggccgctggtgcaaggaccagggatcccaccagctggtgtggggccgggacgtggcgtccagagctttccccacctccgagaggctgtgtccctcttgagtgatggaaaattgcacactagttgtgcacctgcctttagtgagtttgaaatgtcaaagggagtgcgaccatcatgaccagcagtgcgcatacacggaggcaccatggcttgtgtgggtcacaccaaggctcagcttcttggccgtcagggagctaggccccagcttccccagggtacccctgagccaggtgaggagtccacaccaggctgaagaccccccagcccgccttgctggttcacacagccccagtccctggctgaccccgtcctctgagtctggccaggcattgtttcctagaggccgcatggcctgaccctccctggacacatggcccaggatgtccggcccttggggcagggtctgggagccagtgccccttagcgagggatagcattttcttggggactttctagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgcaacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccccagccccgggttgagaggccactgtgtgcctgtgtgtgcaacagcctccgtccagccttgcaccctggcctcacctatggggccctgcagcccttccccctccccgtcccagcagctccccgcacccggggaggagaggcgcggcccggcgcgccgtgggaccccgtctcagaaaggccacacttcctccctgtaggcgaggaggatggccgagaccagtccaggttggagacccaggtgtgggaggcgcacaacccactcacagacaagcagatcgaccagttcctggtggtggcccggtgagtcctgctcctgggcaaggccagcaggggtggtgcctggagcttctgttctcccttccctgtggtgggtgttggggacgtgacagtcttggatcccatatcccaacaagaagcccatgcgctgcagccctgagacccccggtagcagttcccagagaggctcgggagtgctgggtccaggcccttcattaaatagaagggcggcccttctggggggcaggcctgtgtgcctgcccatgtgtccctaatggggctttcccaggatgggccagaggtgctttcccactcctgggccactgggagcaagtgggctgggcctggtcatggagcagagcagctgcagcccgggcagacccctggggcagggcgaaggccgaggcccaggagaggaccatgcaccttccctgccagcagcctgggaggtggagaaaaccccaaaagaagccccaaggcggctgccaatctatcgggatgccctcagttagacgcacacgggttctggggtgggtgccgggccctactccgcagcctggggcccaggacacgaggagtcctcgccacctgcgggctgctccctgcgatgctcatgcagtctgtccctggtccctggcgcctggggagctgtgtgcctggggggagtccgcgctgcccgtggcccctggtccctggtccctggggagctgtgtgcctggggggagtccgtgctgcccatggcccctggtccctggcacctggggagctgtgtgcctggggggagtccgcgctgcccgtggcccctggtccctggtccctagggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccatggcccctggtccctggtccctggggagctgtgtgcctggggggagtccgtgctgcccgtggcccctggtccctggcgcctggggagctgtgtgcctgggggcagtccgtgctgcccatggcccctggtccctggcacctggggagctgtgtgcctggggggagtccgcgctgcccgtggcccctggtccctggtccctggggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttctgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagagtcttcatggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagcggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggacctgcttcatcagctgccctctgcacctgcctgccagcaggggcctggcctccgtgcaccaagcacacctcgccctctggcctcccgccccctctgtggccttctggccgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcctccccgtcctgcgccccatcctctcccagcaggtgggcgtgcactgctgcagcaggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccgccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcctgcgggtggtggggagagagcagcaaccttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgcaggcagcttctcacccaagctcatgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggtctggggtttaggtggtgcacacccctgcctgtaataccattaaggcagcgtcgtacctgctgcctgcagggagtatacttcctgagccacgcccactccacaggggcagcactcaggcctctgcacgccctcggcagggggaggagcagcctcaggcggcagggggttcctttgcctttgagcatctgaggacacccgagaacctcagccggctaccctggcccagctggaagcagcttggtggctgggccagacatttgtggtggcggtggggggcctcctccatttgctgggctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacgggcctgtgtatggatcctgttgtcccggggctgaggggcctggcccccgccaggtggtctccctgctctctggaagccctggggtgcgggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtaactcactggggtggtggggggttggccaggcacagcacctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaa

SEQ ID NO: 1277 - DNA, 50873 bp, Homo sapiens; identical to SEQ ID NO: 1276

SEQ ID NO: 1278 - DNA, 84 bp, Homo sapiens
gtctgggggttctggagtctaggattccaggatctgggttttgaggtcttgggttgtagggtctgcggtttgaagcccctcttg

SEQ ID NO: 1279 - DNA, 2932 bp, Homo sapiens
aatatatataaagtgccggtacaacgctctgaaaaatagttttgtcccaaaatccagcgcctagggtgctccgggcctagcctttgccagtgaggtccaacggctgcaggaatgggggcagcggcagctcgtccagggcctcggggaagcggcctggagagatggcggtgaccagcacctgcatggcgcgcgcgaagagcgagggcggcgccaggcccgccagccactggaacttgtcctcacccagcagccgctgccagcgcggccggtcgcccagcagctcctggcgggccgagccggcggcacccacgggggtgtacagcgccaggaggtccagcagcagcaggcggcgctggcgcggctccccgggagctgaggcgggggctccggcggcggagggagtggccccggcgtcgcggcccagctggcgcagcagcagctcgagaggcgtgaggccgccgccgtcccgcagaccgggcgaggcgccgtggcccagcagcaggaagaggcactcggggcgcgccagctcacaggccacgtgcagcgacgtgccaccgccctccacgcggctgcagccacgccggtccagcacgcgcgcccgctcctcggccgggaagtcgcgcaaggtgcgcaggatgcggcgcagaatgcccacgcggttgtagcgcactgccagcgccacgtgcggcccgggagccgcgcagcagcggaagccggcactgggcggtgcgagcgcgcgccgcgggaacgtggccagcaggtaatgcgcgtacgcttggtggtcgtgcacgagcgcgtagagcagcgcctcagagggcgagtaggcggcggcgcgcccgcgctcgtcccagtggaaggcctcgctggcgcgcatatcctccagcagccacacgggtagcaggtcgcgcaccgcctggtagaaggcgaacgacgacttgcggcactgcttctgcgctcgcgagcgcgccgcgcccgaggcctcgggcccgccgtccgcgccacccccaggccgccgcgcgtcccacggcatgctggcggcggggcgttcctgggcctcaaggcatggatcccgcgaaggcacacctgcggggaaaggaagaggccacggtgaggcgcggggaaactggggaggcccggggactcccctctgcccctcacacagcccctccggtcctggcccaccaggcctgtacctacctccagcctcggccaggcccttccagtcaccctacagctccatctctccgacgcccagaaccaccgcctccatccttgatctagctgtacctgttctccctccttgaaactgacttgctctctggcacctctgctggaaatgcccttgctgcccatgccctcaaatctcccctcccctctccaacccagggacccactggaagagcttctgttcccacctaagccaggttcatacgaccccaaataaagaaaaggccagggaggggatgagaaagcttgggcccacatctcaagctgaggcaaatccactctccagcccaagcgcaaccctgaccctgatctccgaccccagaccacttggaggcccctggagcctcttcctgggctgttcagaggcatgatccagactcagacctacctggttcctgcaccgcgatcacctagttccggggatgtgggtatatcacagtccctggccgagcctcagctttatctgtaagaaaggggaggggtggacgacggctgtgcgggcggggtgagcctggggcgtggcaccagccctctatccaaacatgtttgcttacacgttagctcctgggaggagataggagggtgaaaacaacctggagaccggtgtgcaccgcactgcacagtctgccatcctcttcaggtcccatacctctcttgatctccccgactactagatgaagcgggtactgccatcccactttccagcagggcacaagcttctccaattctccaaggtcagcaagccacggcagagccaggcctagaactcaggtcccctgcgtctcagtttgggctcattccagaattggtggggacccccaacccacaggcaatcgagcttaggccctgaccctgccctctgagtccccagccccgacctgagcctaggcgtctgacctctggctccgtcccaacctccctactgccttctttcaagggtaagcccttggtcacaaggggcctgggacagaaggcaggccgcgtccacacacactgactgggtcactatcactggcagtaactgagttaaagagagcggcgcggtgcgggtaggctgtggcccgtgggcaacaccgtgactggagccccttccccaagcctgggcctccgggccccagatatgccctgtgccggcacgcgtggggcgccgggcgggttacgtaaagttcggcctccccacgtcaccgggcagagtcacggccgcggctcgtgaataagggggttgggccatcgaaggcagcgccgcgcccggggccacccgccacctcctacccgtcccctcccggcctgcacggccagacgtcgggcggcggagggtcgcggggccgagcggggcgtccgcgcgcaggtggccggcgcagcgagggctgcacctgcgtgcgcgtgtgccggaggaggagggggcggcggccgcgggcgcggcgcgggggacggggactcaccatggggggcgcgggggccacaggccgggcgtccccgcccctgccgcggaccggagcgcgcgctgtcccccgcgggcgagcgggcaaaggtcccacgacggacgcacgggagggagccaccgccgcccgcgcccgccgcagccgcgctctgagccgccgcggccggatcgcagggcggcggtgccgtcgccggcggcgggcggcgggcggcgggcggcgggcggcgcagtgcggccccggccaggcaggacagcgggaccgtc

SEQ ID NO: 1280 - DNA, 8188 bp, Homo sapiens
agtctcctggtggggtgcaaggagccgaggcgagatgggcgtcctgggccgggtcctgctgtggctgcagctctgcggtgagccgggaccacaccggtgcgggcccggacggtagcggtctgtcaggacccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggcccccggggatggggttcctatgcgtcccgggtgatccgcgcggaccttccgcacttctctgggtgggtggccttccctgagaagggagcatcccggagagcatcccgggcactcagtcgcctcctccccagcactgacccaggcggtctccaaactctgggtccccaacacggacttcgacgtcgcagccaactggagccagaaccggaccccgtgcgccggcggcgccgttgagttcccggcggacaaggtgcctgggagcgccggcggggtcggtgatgggcctggacccctgagaccgtgtggccccggtgggggttgctcccggctcggctgaggcagcttcttcctgcagatggtgtcagtcctggtgcaagaaggtcacgccgtctcagacatggtaaggccgggctgctactgccactgggctgggggttcacagagtctctgaagcgccttcagggactgctgtgccttgagggcggaccccaccggcatggaggcactgcaggactgggactttggcctctggagaatattctaggaggcagggagtgggggggaacctaggggagcttggtcccatggtcccagccaggctgtgtcctgggagggatgggaggcacccctgtccccacagcccttgtgatgcccagcagtgggtggtcttcccaggaagcgcctgctccatgcccttcccccaaagccttgccttgtcctggtgcctaaagctccatctttagaacactagggaaagtgtccccaacacccccccctctacccaccatccgggtccctggcctgttaggaagtggccgcccaggaagaggcgagcccactcctgcctggctctgcctcccttcagatcagatcagattctcctagggacccctattgtcactgcgccagcgaggggcctgggtgggtgtgcactccttaagtggctgacatctgagatgggacagcttaatcctgaaaccttccccactcccatcagtccatggaagaactgtcttccacaaaactggtccctggtgccaaaaaggttggggactgctgccctaggggacctttttctcaaactgcttcacacaacactccaagaacatgatgggaactgggaggaaagcgggttccatgagtaggtaagtttgggaaatgctgcagcctgcactttcctggagcttcatcacgtattaaaggctctgataaggccccagagaaagaagctaatttccttgtttaaggtggagttccgcaagctacaggccaaatgcagcccctacgggtggagcaaggaacggtttttacactttgtaatcgttggggaaaaaaagaacaatcttttgtggcacttgaaaaatatatgacattcacacctcagcgacagtaaatacagcttcactggcacacagcctgcccgcttggttgagtatcctcggtggccactgtcccattgcatcggcagcccaccagcttccagggtgactgtggggcctgcaggccaagcctctgggcaaaagcttccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttccttccttcaggttttccaaagctgccttaacccaaaagctgccacacactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttcatgatctcctttggaagcacttgggctctgaaaggaggcaatactccattcattcatctattcaataattcattcattgatcatccattggccggtgggaacagcgcaggggcaggggacagtggccccagggtcccagcctgcagaggccgaattcacccagagccgcccaagcacccccatcccctgcccgcgtcggctatgttgccctccacacccctggctcccagcttcatccatctgcctagatgaggcccgagtaacaggccgtgcacatcagtgccttactttgtaattctgtggttgggagcgtccctccctgcgattttccttttccttgcccttcctcccatttctaccttttgcctgctttcttgttgggggagtctcctgtctttcacccatccccctgccttggctggaggctttgcaagtctgctcactgtggacttgcctgcagtgtcctgtgctgaacagaaaccttcattttaatcgacctaatgcaaaacgccttaccttagaactgtgttttttctgtttcgtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatcaatactttgttaagtttgtttttttgagacagggtctcactctgttgcccaggctggagtgcaatggcgtgatcacggctcactgcagccttgacctccctgggcgcaaacaatcctcccacctcagcctcccgagtagctgggactacaggcttgtgccaccacgcccggctaatttttgtagtttttgtagagatgggggtctcactatgttggccaggctggtcttgaactcctgggctcgagtgatatgcccgcttcggccttccaaagtgttgggattacaggcatgagccaccgctcctggccttaagtttggtttctattataaatgttgccctatatttaaaaattatatcctctttttatttttaaattttttgtagagatggagtctcactatgtttctcaccaggctgatctcaaactcctggccttacctactgtgctcgtctgttcaactattatgttacgtttctatttttccccttcgttctttaaaaaacggtgttcttggtatgcttcctcctgggaacccctccctgttcctgaggcgctttgagctatgacacattccgtccccacggctccacctctgcacctgtggggggacttgccctgctggcagtgccacaccctcaggtgtgcacggaactgaagtgtgacctcacgtcgctgggggtgttggcctcttgctcaggtgcagtgctcctggaagggccgaagagtgggtcctgcctcgggtgggcgcgccctgctgtgctgagcccctcacaacctggcagcaagggttgccctggcccagcgctcaccctcagcccctgagggagaagtgcagaagcaagaaggcaggaggctgaggtcctggcacttggaggagagggggagtgaggggcggccagtcagaccccccgtatttctgctgacacccgagacttgggctgtggccccacttctgtggtgcgggagctgcacggcccagcccaagcctataggaaacagcaggggcaactccacctccccgctacactccctgcctcctcctgcacccctggccgccagatgcagcctctccctccctccctcacacaccaagagcgcggcctcagactccccaggagccgggcaactttcgaaactttagttcctggaacctgggagccctgggcctgtgcacgttctcaaggggctacggggggaggcgacaggccctggccagagtcacctccgccccagactccccacggctccgtctcgctccccggctccggctctgcccctggcctgtgagacctccagctcagggacaggacactgggctgtgcccgcttcggggccttgcccacgcggccccatctttcccaggccagatccgcttcctctgccagcctcagccaggccgaggaccccgggcctgagctcgcccgggctccttccgtgcacagggtctcggcttctcgtcccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgcccccaggccgcctgccacagcgccctccggccccaggggcagtgctgtgacctctgtggtaagcgcccccgccgggccctgcttgctgggaaggcctggaggaccaggttcgtcccccgcctcagtttcctgccgggcccggatccacggcgctgacccctgccctcccgccgcaggagccgttgtgttgctgacccacggccccgcatttgacctggagcggtaccgggcgcggatactggacaccttcctgggtctggtaatggggccgcgcgggcagctgaggggagtcccgaccccagccctaccgcctccgcctaggacgccccttctgcagggtccctgcggctgctcacttgcccactatctgcctctgcccttagcgtccccataggctcggggagggcggggggctgagtcaaaccaaccccgtccccctccccagcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggtaaccgcgcccgccccatcccgccccgccgcgcctcgccccgccgcggggaagactgagccggcccctccgtcgcaggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtacgcggggcgggggcgcggaggtggggctgggggttgctccgaggggctcacgctgcgtccccgctacgccctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccacccgctctggccccagtcgaactgggggctagccacctcctcgtccagcccccaaacctccccttcctttccccctcctccgggggccaaggacagggtggccttactcagtaaaggtgtttcctgca

SEQ ID NO: 1281 - DNA, 10415 bp, Homo sapiens
ccccacagggccacaacaggtttctgcatctgctcctatggccactccttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccagcaggcatccactggggcagcgtctgaggaactgaaacccgaggcaggtaagggcctcagaaacaacacgaagcatgaaaggaaacgggccagaggtcagggcagctcagctgaggtttccggaaaggctgtcctccctagctccccaaaccctgcccccgaacatgtgcaattctttatttatttgagacagggtctccactctgtcacccaggctggcatgcagtggtgcaatcacagctcactgcgaccttggcctcctgggctcaagcgatcctcccacctcaactttctgagtagctgggactacaggtgtaagccactgcacccggctaattttttttttttttttttgacactgactctcactctatcacccaggctggagtgcagtgacgcaatcttggctcactgcaacctccacctcccaggttcaagtgattcttctgcctcaggcccccaagtcactaggactacaggtgcgtgccaacacacctggttaatttttttttttgcatttttagtaagacggggtttcaccatattggccagcctggtcttgagctcctgacctcgcgatccgccccctcagcctcccaaagtgctgggattacaggcgtgaaccactgtgcctggcctaattttttaaatttgtttttatttttttgtagagatatggtcttgctatgttgcccaggctggtctcaaactcctgagctcacccaatcctcctgccttggcttcctgaagtgctgggattacaggcgtgagccaccatgcccagctggacaattgcactttaaattcttgcagcatctctgcaatgggagcccccccattgggcagataagaaaagtgaggctcagagaggtggagtgacttgcctcaagtctcacagcgtggagaatgggacctgaacccagatatgcatggccctagatccccacctctccatggcctttcacagcctggctcctggtcaaactagggccatgcacacagctgatcacagggttgcagagggtgcaaggctcgcagaggtaccaggaggggaggtcagggggattgcccagaggaggatacactggggtgggaagagggggacatggaggtggagagctcttgtcgggtggaggctggcggagagtggggagcagcaggaatgtaaagctggacacgggcaggacacgccctgcctgagctccgaccctattagacctgcaatcagggctgagcatgaggctatcaggtccggctcagccgggagtggaaggtgggtgtgggatccaggcggaaggtaggggttgacccaaattgctctgttcagccaggcttggggccccaggttctgcctcttcaaaggtgactctaagggagggctcctggcagctggggcctgttgttcctggagcaggccttcagctgtgctggggcatctggcagaggacagacaatccagccccgatggattgagccgtggcctgcaggtcttcgtccaggttcgggtcttggggcggtccctctcaccgcccttctcgcccgcctgtgcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgcgctggccgagctggcccgcgtggtgagcgcggaggaggaagcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcaggtgagtctcggccagggcgcccagtggcgaggacagctgccgcttcctccgcaggccttggggagccggctttgaggagcaccggacctttcttctctgttccctccctgggagagggctgagagccgagggcttcgacatgctttcctcggcgggttaggccgtggggcgctcccgccccaggttttctaggggtcacccatacacagttccagaatttgaaaagtttccgcggggaggttcccatgggagcagggcctgtgctggttccaccaggtgcctttgggcgcatcagaaaagggcacatcttggccaggcgccatggctcacgcctgtaatcccagcattttgggaggctgaggcggccgatcacctgaggtcaggagttcgaaatcagcctggccaacacggtgaaaccccgtctctacaaaaattagccgggcatggtggcacgcacctgtaatctcagctattccggaggctgaggtaggagaatcgcttgaacccgggaggcggaggttgcagtgagccgaggtcgcgctattgcactccagcatgggcgacagagcaagactctgtctcaaaaaaaaaaaaaaaaagaaagaaagaaagaaaagaaaaaagaaaagggcaccccgttaggccagacgggcatctgggttcagggtacagcctgcggggagcggccacctcccgctctctgcctgggatgaggatggattgccttccccgcggagcggttcccagccccaccggcaggagcgcccacggaggtgggggaggttgcctgaagtcccgcactccttaaattgctccttaaattgtgtggggtcagacccgtgtccgccctgctgtgggcctccgtgctgcgggttggagggtggccgattcctgagctgtgtttgaggagagggcggagtgccatctgggtagccgtccttcagcgttctgcaggaaggcaggaacccagctgtcagaggcttcccgggagggggtgtggcatggcagcctagaggcgcgcgcgcgtgtgtgtgtgtgtgtgtgtgtgtgtgtgtgtacagatgcccaggttcgggattggcgttagactttgagcctggccagaagaggggcagcggctgccgcatcagagccgctcccgcccccagccccctgccctgtcttccagtcctgacttcctgggcgccccggggctggcgctgcccgccgagccgctgcctccgctcctggcgccggacgtgtgggcccgactggagagcgactacaccagcttcctggaggtcaggccgggcgggtcaggctgggcgggccaggctggagggggcgggccctggggggatgtgcggcgcccaggctatcggcggccagagctggctctggttcaccctgtggcccccggcgcgggcttgtgacccgacagggcggccctcatcccggacggcgcgggacggggtctgggagggtctcaccacggcccatcccttctccccccaggccaagatcgcaagctgcttcgacagcatcttgcagctggagcagagtcactgggcggccgccgaggtccccgaggtgctgcagggcctctaccaggcgccgctgtccatggacgtccatatggtgcggcccgggagcaggggctgagaaggggcgtctgttcaagcctcacgcacacggtggcgatttccagaacgaattcctatccagtcccaaccaacccttccgttagatgggagcctgaggccccacgcggggggaaatcggggacccccggcgcgccgacgggcagggaggctgctggatgggagtttgcgggagttgactctccagttgggcggctgaaagctggaggggccaagactgacaggcacagcggggcgggctggaggcgcagcgggggctaccaggggacccgcggcctcaggtcgggggctgggaggcacgctcagtgcggggcttcgctcgcagctcgtggccgagcacgtgaaggcggccggcgccatctccgcggagctggaggccaccaccctgcgaatctgcacgcgggcgctcggcctcttcgtgcccaggtgcggacgcatcctcagtaggggagcgacctggccgggtgcgctctgcaggtgggagggaggagtctgcgtagggacctgattgggagggtggacccagggtcatcgcgcagctagggagggtccccaaaggctctgtgtatcccgccccaggtttgaaaaggcttttctggcgtcggaggcggtgagcgagccgcacctgggcgcctacatcaacgcctgcgaggagctcaggtagggctcgcccgctcctgtgcgggcgcagcgtggccagcagggggcgcgcgagcgccgggaacctggatggaggggagtgcgcgcgcgtggagggggcagaggtgaggagtgtgtgtgtgtgtttgtgtctgtgtgttggtggatctgaggggtgtgtgtgcgtgtgtgtgtagcagagttggggggtgtgtgtgcgtgtgtgatggagctgagggtgtgtgcctgtgtgtgcatgcgtggagagctgaggctgtgtgtgtgcgtgtttggcagagctgagggctgtgtgtgtgtgtgtgtgtgtgtgttggagctaagaggtgtttatgcatgtgcgtgtaggggtggagctgagtggtgtgtgtgtgtcagagcctagatgcgtgtgtcttgtgtgtgtgtgtccatccgagcaggggccctgggggagtgtggatggctcttcaaggctgagcagaggccgaggggttccagctccctgcctgctgccctgggctccatttttccctcccttcatcccaggcagcatttcttccatcttgggacacctccttctctgggaagcctccctcagcctgcaccctgggctttgctggggtgaggtctgggtctctgtgtccccagaaggcagacgccctccctgtgggctggcagtagctgttggccttccgtgccctcagctccaggccaggcctcagcagatgcggcagcgccagaggcacagactgagcctccccatctgggtttatccttttttaaaagtgtgtaaattttagtgtcccgaagtacttctcatttgtctgacttcaaagaacagctgtgccacctgctggctgtgtgctccgggacaagccacctcccctctgtggctcttttgccacctgtcaaataggatcagagcacctgctccctggggtggtgtgggacctctgtgcctcaggggactcagttcccattggctctttgtgagcacttctcagtgccaggcactttgtgggtgccttccctgcctgacacgtctcatcccaagcgcagtatacccacgcacaggtgcagagcacaggcctggaaaggaggtgccacttgcccgtggccacgtagccaggaagtggtggagctgggacttgaactaggcctgcctaaatccaaagcatgaccatcaggcactgcttctccaacactctcgtccttaatctgtgccaggcttgtccttggtgctgggaccctggggtttcagctccagggagcgttctctgccccttggtaggcagcctctggccaaacccttgatggaactccagcctgctctactgtgtccctggctgcggggactgcgtatagcctggccctcagtttcctcaacagtgaaatagggacatggtcaccttcagggggcagttataaggctcagggtagggtatgttccaggcatggctatgccgcactgtttatcaccaagagggatggaaggtctgtcccagagctgccagaggggaacgggtcagccacccctgacccacccctttgtgactggctccctgggcttctgtgctgtcccccacttgactctgctcgcagacagctacaatggggagccccacgggctgcccttcacattgtagtctaagtgagtggagctgtgtgcccggctctattccccagcctggtctcccttgcccacctcatcgctggtcctggcccctccccaggaccagtcttctctccaggttcccaggaacccaagaggagctggagaagcccctggtgacggccacctgcagcttccagaagcacttgcttcagggcttgcagcgtgagttgcaggtgactgtgataggccctctctccctacttcccatgcccagcaggcaccccctatttcctagagcctgggggcccaggtcacagcattcatttattccagggtgagctcatgggtgtgtgtgtagggtagtgggcaggggacccaggtgaggtcccagctgagcaggggcggctgggagacgcctgccttctcacttcagtctccagctcttagtggtcacccccgaagcctgggatggtgggtccacggatccaggcccagggtcctcacccagtccctcaaggcttctccagggcatgccctgagcagatctgactgcacagactcaaaccctgcccctagagcttggggcctgggagaggcattctgggaaagggctcgtgacataacctgtggctaggagagggaatggcaccccaaacccaggagggaaggggtcaggagtggcacactgggcttcgagggaggggttacgttgcgggcgtagtgcacatttgcagactcccagcccctctgtccccagccgctcttcagggttgtgtgcaccagggactggctgacgcaggactggctgcatcccctcatggacaaggtggtgaccttcgccggtcatctccagcgtgtggcccggccgcgggcacaggtaccacaagggggagggccctggcagggctgtgcccaggattggggctgttgaccctgaccctgaccctgaccctgggccgcccaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctggtaggggcggcatgactgcccttcggtgctcgcctctgtgtggggagtggtggcagtgactagggccttagcgccgggagggcttttggcaggagtggttctccccactctggatcaggtggaacagggactggggcgcctgtggggctggggggtggagggaaccaggtgggagggcggcactttgcatacatttgcatacagtttgcaggggtgcggggaaggggcgagggtcacagccccatctcacggtcagggcctttgggaggtgtcccccacctcaggccagagccctcagagtggaggcaccagcgcccctgcacacccctcgtctgccccctagcagtgctttcaggctggcctcggttttcctgtccaagcaggatgggatcggaggggagatgaaggctgtgtagccagcccatgagccctcggtgcccaggcacgctcccgttctgttttgggggaggcagtcccggcaccgagccagagtgactacaggagggctgacgctgcgggagggctgacctcgcactgacctcgcgctcttgcaggagttggagcagcggtggggagagggctgttggggcaggcggtggctctgtctcgcagggttccgaggccacatggttggaccaagccatccagtgcgtggctgagatcctgggcgagacctacaaagatgacatccagcggcacctggagactcttatccggagctaccccgacatcaggtgtgtaccccacctgcttccactagcttcctaccagagcttcagggccaagggggctggtattggagcaaccccagcccagacctgactgcccaggggcctgaagaccagaggcaggaggtaggccttggaccctcagaccctcaaggctggagggggaatggagagagccccttctcctaatctgctcttggccatcctccatcagccccaccaggggtgggcacgcctccagtcctggaatctgagggggaggcggaccccccacccctggggagaaagccctctctgaaagccaggggattctgagacctggtcaggaggaaggaggttttgatcccgggttgtgctggggggtcggtgagtcatccaagcctttggaaatcccagctcgaatctctccaagtccattcttttggagattctgggatgtggagctcacagaaagcccctggttcatccccttccccaggccaccctgccatggggtggggaaggattccccatccccagcaggcctgtcttccaggctgtggctcagagagagtggcccttacatcaccctgggagttcccctccaactactccccaaccccgttggccccgtcacccgcagctgcatcaccccctccctccctctccaccacctgtcccccggtctccctctctccctcgccaccctgtccccatgtctccctccctccctccctctccaccctgtccccgtgtctccctccctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctccctccctccctctccaccctgtccctgggtctccctctctctccagcctgggtctctccacccggtccccaggtctccctccacgcctttgcgtgggctctttcccactctgcacacccctctcctgtgccccttcaagcccagctatggtgtcccccaggcccacgccctgccccctcccccagcacagctcttcctggcctcagtcaatctgacctccctgaccatcctggaatgcagagtgactcatactaactcccaagcccgtgggttcgcctcatgctggggctgggggtgttgcggaggtgtaggtctgcagtgagtgcccgcatgtctctgcaggcgggaccacatactggccattctggcgctgcgccgactgggccgccagcggaaccagcatctcttgcagcacactcaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcgggggggggcctcccgcccgactgtccagcttcaccctccagtctgaaagtgaagagcagagtatttatttaaaaaataaatgtgaattaa

SEQ ID NO: 1282 - DNA, 11114 bp, Homo sapiens
accagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacaggtgctctaggaccctgggttagagctagtctggggcctggacggggttggcgctcatccgcgtgagtgagccacttgcacagtgggccggcaagtggggctggaaggcgcgtctgtctccctgctttcacctgtgccgcaatctggggggctgggaggccttcagcctagtcagggacaccgacatcaccctttagggtgttggccgccggccctgtgcgcgtctaggggaggacggtcccgcttggcgctggccgccccgcccggtgggcggtgggctggggccggggctgacgcggctttcccggcgcagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaagtgagcagaccaggggctgggcccgggccggcagggagggtgtcctctgtaggaggggtgtcgaggggtgtcgaggtgtgccgccggcagcttttagtgaggtcggtgtttgcagagttttgggtccgagaatgcaggggtgggacttggactccctggggcagagcctggacaggcagagactgggcctggacacagggataaggctggggctgggtctgcgttgctcttggaatccttaatttcctgggcctcagtcacattctgctgttggggaaactgaggcacagaaaatggtagggatttcattcacgagcgcccagtctgaggagggggcaaagcaatcaataaccatccagagctggaagggctgtggcagcagaggccaggccccgtgcagagcatgggcccaaagcaggcctggagaagtcagggaagccagcctggaggaggtgaaagccagcggtccttctctgagccagggaatcaggccaggaggcaggaggaggggtgatagggcaggtaggggagaaggtgagaggaaggtcggtgctcctgagcatgtcctcttccagggcactctggagctgagcagagctatgcgggcacccccaggcaggagagttccaagtgatgggctagggccacgtgtcttgttagacccccattgtgtagggttaccctgtgagcccgccgcagagctggagcccctcaggtgggaggctggctgtgcagctggtacccctgctgagtacagcctcaggcgtcccttgactccatagatccctgggcgtgcccgtcattcgcacggtctgcatggagagaggcttactgcagtgtggaaaggcccagggcgggggagtccaggggctgttattgtggggcttggccactgctggccccagatcctagtgtgaaactttaggaaggaagcctggaggtatagacagtgtgggcagtgtctgccgtctcgggggccttgggtggcctgtgggctcagttcgtgttgaagggtcagcctctggcagaaggatagagaaagggtccagtggagagggtgggagaggagtcagcagggcataggggaactggcacagggcaggggccacgggagagataacccagcccagagccagttcccgcttgctcgtcctgactcaccaggaaatgccgggcacctgcacccctgcctgccagtctttctgtcccagtgacctcggggtctgctggcctggggttagcaacaggcaactaaagccaagctgggcatggagccctggtgagagggtgcccaggggggcatcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagcgcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaaggctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggcagatccgactgctggaggccacattcctgtccagtgaggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacgtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccaccgctctcagagccacggcccctccctagtgcctcaggtggggagctgagctggatccccgccctctacccctgtccctgtcattctgagccaggagttgtttcccactcagccagggcactgagagcctcaggtggtctgacctccaccaggattcaacgtgggagcctcttgcgcccaccccatcagcaaagctctcagcagagcagcctctagcttcaaagaggataccccaggagggactgagaccccgccaccccttcatacaacactcctagtctccaccacctgaattctctctgctctctccctctcgacctctgagggcttctccagccaaccacacgctcactcctacctggtctcccaactctagagagggcctgggagcagcagagatgggctggtaccctcttcaggagcccaagccttagcttgtgaagccagttccatgatgcccaggggctagcggcccctcccttggctatgggcagccaaacagaaaagtgaaccccaggagctggcagggagggcagggaggctgctgctgtggtcccagtgtttgggctggtcctgaatgtgccccttctggtttcgccagctaccagcgcgcctttaatgaatttctggagagaggcaagcagctgacgaattacagggccaatgttattgccaacatcaacaactgcctgtccttccggtgagagtgttgggaggggcttgcgggagtgggagtcactcagcgggcaggagaggggagctggaaggtggagggaggaggagctgcttaggccaagaagtggaattcaaaccagcaacatgtgtgaggactccacggcctgcagcagcagcagcaaacatttcccaagtgctggctggggcaagcacacaggcagatgtttcacccattatcttatccttaaagcaaccctgtgaagtaggtatagtgatctgtctattaggcagatgggcaaaccactggaggaggctcacttgcccccagttacaaggggatgtagtggaggagtgtcctgagggcatggagaacatggatgggaggacttgatcccatagagaatggggagccattgagggttctagagtgaagagagggggctgtctggctccctgggtatggggctataggctgagcagggctggggtgacctctctgcctccaccttccaggatgtccatggagcagaattggcaggtaccccaggacaccctgagcctcctgctgggccccctgggtgagctcaagagccacggctttgacaccctgctccagaacctgcatgaggacctgaaggtagcgggagcctcttgccctcaggagcccagtgttggggggttcccagggagggactgggaggtgcccccagggaggagtggcagaagcaaagatgtggggaagacacgctccaggcctgtggacggcaccgtgggccagctctggtgcagcggtgatgcccggttggggaccctagcaggctctgaactccgccgatcatgtcctggggtttcacctgagaggggccgcctggggctgggaggggccgcctggggctgggaggggccgcctggggctgggaggggccgcctggggctgggagggcctggaaaagtttcactgcccctccccgattcagacacagcccagtcccaagcctgcagacacctttccttcaatcccctcagcccctcctatccacccccatccccgcgcctgactcccagcaactgaggctcagggtcatcggcagctggggttatatctgttatgggccaagaaatccacagaaaatgctgtgaaaacaagtagttcctttagcagggtgtaaagtggggggtctctcaaaaggaaggggagaggttctcttcccggtgtcagggactagcggccatgggtggcctgagtgtggtggaagcccgagcggtgaccccacatcccctggtactgatctccctggcccagccaagcacaaggtcttgtttatgaaggaatttatttatttaagtggcagtggacttggcctccgggccggcagacaggctctcctggctcctgagccgcactgggtgaccttggataagggtgcacagagccggctcccacttcctgtctgtgagcagggacctgaggttggcccgggttccctgggagtccttgagtgccccccgcccctccaccaggcacatgtgtcggtgtgtgtctgtgtctgcgtgtctgcgtgtctgcggctggcagcccttcctctccagggcgtgactagacatcctgcctctcctgtctcagccactgttcaagaggttcacgcacacccgctgggcggcccctgtggagaccctggaaaacatcatcgccactgtagacacgaggctgcctgagttctcagagctgcagggctgtttccgggaggtgaggaggctctgggctggtggctgggtcttggggagttgggggcagcccggacacgcacactagcacgtctgtgtacactcacgcacatgtgctcacacgcgcacatgtgaacacacgtgaatgcacgagcatgtgaacacgtgcacatgtgaacacacgtgaaggcacgaacatgtgaacgcacgagcatgtgaacacacacatgtgaatgcacgagcatgtgaacacatgcacacatatgaacacacgtgaaggcacgagcatgtaaacacacacatgtgaacacgtgaacgcatgcacatgtgaacacacacgcatgtgaacgcatgagcatgtgaacgcacacatgtggacgcacgagcacgtgtgcagtcttttgctctggcatctgcctctctctggaggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgctggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctggctatccgtctatcttctcacccactcatcacctgtctacccatccacccacccacccacccacccgtctatccatccatctattcatccacctacccatgtaagcacccatccacccatctactcatccatccacccctccacccatttagctatccatccactcaaccactcacccacccacccatccacccatgcatctactcactcatccatgctcccatccctccacccatctagctctcatccatctgctcacccacccaccatccatctacctatgccaccaacaattatggagaagtctgctaggtgtcagcctctgttctagttaccaggatgcaatgaagtacaagggaagccaggtctcagtcctcccttaagtagctcattctgttgagggccagcaatactaatgacataatcaggcaaagaaacagacaattacaagttgtaaatagggtttaaccaaggttgtgaatgataggaggtgccgactttagagacaagaaagccttttgggggtggacatcttagcggagacctaaggggtgggaagaggcggtcatctcagggcctgggaagaacattgcaggggaacagccggtgcggaggcctgaagcaggctggggcatggctgctcttgggaccatcaggtggagggcatgggtgagggagagtgaagtgcagccccctcgtgggccgggcgttggctgtcgggccctgtggcactggccgggagtgcagggagctggtgagtaggggtgtgggtgacaggctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 1283 - DNA, 1809 bp, Homo sapiens
atccatggtgaactttatttcagcgaatagaggacaaagatcagcgacagctcctgtgggattcgggagatttgtcagccacgtaggcatagaagatgggaaaatgggatccacttttttcccctttggggccaacctggcaatttgtgtgcaaagcacaggaattccacacaaggaatttggcgtaatagaagtaattagggctgggcgtgctgcctcatgcctgtaattccagcactttgggaggccaatgcaggaggattgcttgagcccaggagttgaagaccagcctgggtaccatagcaagatcctatctctaccaaaacaaaacaaaacaaaacaaattagctgggtgtagtagtgtacacctgtctaaaaaaaaaatgtaattagtaacaggaatgctccaaactcaggaaaaaaaacaaaacaatatttttaaactgctaagaagaccaaaaattatttcaaaaccatgaggtaaaatgacagaggtcctggtgaggagaggactttatcaagggtgtaatggaagacgctgggcatgattcacatgttgtggagacccctggagaaggggggctagagtcaggcaggggtgtgagtgacccaggcacagaagtggggcaggagggacttgggaccctccttctgaagctccccaggaggctcctccttttacctgcccttgatcctggagtcctctctgccagagacaggaggccacatggttctcaccaccaggctagtggacaaatccctttgtttccagggtgggcctggaagggattaggttactttctggtccacaccagaggctcccctagaaggcagacagccccagggactgactcagggacccagaggctgggatgggggaggccagggagtgaggccagggcaggcagctgtgggggctgggctggggagaggaaacagtactggggcagaggggacgcctgtaatcccagcactttgggaggccgaggtgggaggctcatttcagctgaggagttcaagaccagcctgggcaacatagcgagaacggttcctgggggaaaaaaaaaaaagaaaaaaagcatgaaatacaatgtgtctatattgaaatctgtactgtaattgagatgaaatactgtggaaaaactcaaggaatttacctaaatgctccgcaatctaattccaaataccaatggtaattctcaatacctaattaggaaaacatcacaacctgcatttgaagaaaagagtaacgttcaacttctaacgaggcgtgcgatcatttcggcacttggaacatgaaacaaagtcaaaacattttcaggcaaggtgaattgctgatcaagtatcagatgtccaggtctgctccccttaccgttgcgattgattcaccactacatctcttctgaaagtaccacacggtgtggaatcctcaacttaagtacaaaacacgacgaaactgattaggaaaatccatttgtcaactgtgggaggctctggatgtgtagagtacctagactgtggtaacccctccaccctgcgtgcctccatcacatcatccagctgttcaccttaaataaatacaatttctatccatcaattacaccgcaatagagctgggggccattttttaaaaacttcctctggcatgcagcaattgataagaacttgcaaagctgagaaggcaccgatttaaaactcgcgccaacgcggctgcgcgccttgtcctccgcccaggaaccctggaggccacggcctcgcccggctcctgcgctggcactggacgtcccgccggctgtacctggcgccccg

SEQ ID NO: 1284 - DNA, 10165 bp, Homo sapiens
cgggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaa

SEQ ID NO: 1285 - DNA, 127 bp, Homo sapiens
caagcaacactctgtggcagatgatcaaaactgtctgacacaatttgagcttgctatagcaagaaagtctaacctattccggtgttctctctcccatgagacaagccgttatatagacttaaacagt

SEQ ID NO: 1286 - DNA, 11024 bp, Homo sapiens
ctctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacggtgagtcgcgggcgcggcgggccaggagatggcggccgcacaagatggcggcggccgccgcgtgaccccgccgcggcgtgtggcgcagtttgggcggacggcgggcgggcgcgggcccgggcgccggccgccccctccccgcgcgctccccggcccggcctcgccccctccccggcatggcgggagcgcgtcgcgcgtgcccgccgctcgggctgactcaggcttcagctgctgcatttgtgagtcatcgcgcgctctggggcgggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaa

SEQ ID NO: 1287 - DNA, 3203 bp, Homo sapiens
ctcagacgcaggcaggccaaaaccctagtttatttcagcatcagcagtatcttagccatcaaaaaaataaactctaccaagggtgacggaagtctctacagcaaggctaagggctcgccagacggcgaacatcaggggtgcatggtgggcactgcccaggcaataagttaggaagcagcagggctggtgtcgggtgtgggccgggcttcatttctgggcaggcatgaggtcgtcgatggcctggccctgctccagccgctgctccatctcgatgagcagcttcactccgtccaccaccatctgcaccagctccacctctgagaagcccaggcggtcagcgttggagacgtcgaagaccccgcccaccgcagccgtgtccacaccgcctggggagacagcaagtcagggcggaggaaacagggctgcccaaaggccacgggaagccgcagcacctgccctgctcacctgtgcctcgcttctgaagtcgcagccgcttaagcacctccgagaacttctcatgcttgcccaggttgggcagcttgatatgcacacctgcccgcagcccggtgcccaggttggatgggcaggtgaggatgtagcccaggtgagggttccacatgaactcatagtccttagacttgaagagagtttcaatctgcagacggagaagagggtatgagggagaaggcctgcctgaaacccctacaggccctgagactccccagtgccggaaatcccccggggggactgatgctggggcacccacatccctgctggggccctggggtctgggcctgccccgtccctggcacctgggtgaggccggtgcagaagcgggtgaacacctccttcatgttgccccccttctgcatggagatgacccgcaggtggtcctcctcgttgacccacaccaggaaggtcttattgtcattgtgcctgcgggagggctggtctcagggcatacccagaaaaaagccccaggccgcccccagaccaaaggaacttcccaagtccctgaggtgctgctccctgccatgcccaggagtggaggctgctgccaagactccacccgccaacacggggcgggcgggggaaccgggacgcctcacagcaggagaaccccagctgccatcatgcgctgtggcctgaggtggggcggggccagggaccgccaggacagcccgacccgccccccacagtgggggtaggagccctgcccctggagaagctttggcgtcaccagcccctggtagaatcccagcggcggaggagtgagaaaagaaaacaaagagctccagctcccagggccgtcggggagaggcgccagagagccccgcccccacctcacgtctcggggtggggaggtgttgctgagtcctgagcccccacgggccggggcccagtcccttaacgcacctgctcggccaaggtcaccggcgcaggaggaggcgcggcacggaacccagacccggagcgcggccggcccctccctcctcctcctcctcctcctcgccgcgaggggccccacccccgcgaggggggcgagagggaaagcggaggtagcggggagggaggacgccgcgagagggcgcagagggacacgcaccagataccgcgggcgtcgggccagtcgcgggccatgcccgaggccagcagcaggggcgacacgggcttgtcgaagaggaagtggtcgtcgatgagctgctgctgctccgcctccgtcatgctcttgagcgcgtagtatcggcccgccaggtcgccgtccaggctggacagggctgcgaggggtgcgctcaggacgctcggctcccgcgcccgcccctccagcccgcagcgcggacccgcccgcccccgtgccccacctcgggggacgtcagagggccccacccgcccggatctgcgggcgtccagtcctcacggcccgggcgacggtcccaggcggtgaccccgcgccaggacccgccctccctgggccccaggccgctgtgggcgcggggctgggcctccgtccctcggtccctccgggaaactgaacccgggcgcgcgcagataagagcgcgacggcggctgccgctcccgggcgacgtaaacaaaagcgggcggggaccgcgccgggagggggacgcggccgccgccgcccctcggcccgcccggcccctaccttccaccgcgagcttctcgatggcgcggcgctccccgcggctgcagtgcggggggaggcagaagccacggatgctgcggcccgtgcgcacccgcgagctcagcacgtagttggggtccaggtcgtcgccgccctgggaggcgagacgggagtgagcgcccgaagaccccggccccgcccgcccggcccgcccgcagccccgcacctgcaggttgtcggggttgaggtcggtcttgtgctcatcgctgggcttgtagccgccgtgccggtcctcgatgatggggtcgaagagatccttgaacacttcgtaggactcctcgtcgcccgccacgcagcccacggtcatgatgtacgggtggcctgggggagggggcgcgggacggggacagtgacgtcactgccgggcccgagcgcgctgctgaggaccctgcggctgcgcggggggagggggggccgggaccccggccccgaggggtcgcgtacccgggttgtccacgcctgtctggatgacgtcgtccagcgtgaagccgctcggcgtgctcttggcgcgcagctccgcgtacagctcgggggtcagcaccttggccatgtggttgttgtgggcgctcaggtcggggaactcgtcctcggccgggaagcgcagcttcagtgcgttgtggctgttggagaagggcatggcggcggcgggctgcggggagacgcggggtcagaggggaccggcacgccggggttcccgggctcccgcgtaccactcaggcccccgccgccgggccccccggcgccccccgggacgcggccaaggtcagcggggtccgcagcgcgcgcggggagcgccatcatcgccggggacccccggccggtccggcgcgcgctccaggcgacgcgccccctttgcacgcagcgcccctagcccgggcgcggacgcccccggcccccgggcccactcaccgggcggccgggcgggggcgggggcgctccgtccgtcggcagctcccggagcgacgcaggcgaacagcggccgctccgcgctcccgcggctctt

SEQ ID NO: 1288 - DNA, 27939 bp, Homo sapiens
caatgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtaagcaggggcctggggacattgggccgggaggggtgaccggaagggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggcaagtttgtacctaccttatttgttcccgagaatgattattttttatttttaaagagctcttggcttaccgtgcgttttttttcgttgtgtgtgtgtgtgttttggctttgttacaattattagtgcttttcttcaagcggcgagcactttatcatcgtacttttgtagcacttcacgttgaatagttgttatttgcaaactatgtgtgggtatatgcatgttactggccaaagatccgcaaagaatgtctgtagcaagaatgtctgtggcaagcaatttttataagtggtacttttgggagggatgttttgtttaagggaggcctaggccttgattccgtctgtcagatgaaaatgttgactaacggtgtggaatgggctggagataaaatattcaagcaaagcatgcaaataccaaacaggctaatgaaggaggctggaaaacttggtttaaacaataattaaagaagtattaaaaaagtgttaattaaaaattggacgggctccgtggctcacgcttgtaatcccagcactttgggaggccgaggcaagcggatcacgaaatcaagaggtgagaccatcctgcccaacatggtgaaacgtctctgctaaaaatacagaaattagctgggcatagtggcgcgcgcctgtagacccagctactcgggaggatgaggcaggaaaatcgcttgaacccgggagacggaggttgctgtgagtcgagatcgcgccactgcactccagcctggcgacagagggagacttcatctcaaaaaaaaaaaagctaattaaaaattgcaaatgtacttgcttgtacattttcatttctgttgggctgtggctgttagtacactttcataattgtagctttgaaggtctatctagtttacaatttaaacaaggagttaccagggcaacttgccaaccagacacccaagtggctagctcagttctgtgttacagtgaccaagtccttgccttctatccctagaacatagaaacccacccagcatctctatctttgggcagaaagatagagcaggtgtctgaaaatgctctaagagagcaaacgggaaatcaaccaagacatttcccgggcgggggggattttccctagcttattttgtgaacttgtgctggaaagaaacaacagcacccaaataaggatttctctattgtcatatacacttcttttttttttttttttttttttttttgagttggagtctccctctgtcgcccaggtgggagtacagtggcgtgatctcagctcactgcaacctctgcctcccgggctcaagcgattctcgtgcctcagccttccgagtagctgggactacaggggcccaccaccatgcccggctaatttttttgtatttttagtagagacagggtttcacctgttggccaggctggtttcaaactcctgacctcaagtgatgcgcctgcctgggcctcccaaagtgctaggattacaagtgtgagccaccactctcagccttagacttcttgttaaagtaaaataaatcttaccatgggtctgttctcaagatgagagacctctctgccttgttcgttttttcttttttcgagatggagtttttgctctgttgcccaggctggagtgcaatggcgcagtctcggctcactgcaacctttgcctactgggttcaagcaattctcctgccgcagcctcctgagtatagctgggatcacaggcgcatgctgccacgcctggttaatttttttttctttttttagtagagatggggtttcactatgctggccaggcaggtctcgaactcctgacttcaggtgatccacccgccttggcctcccaaagtgctgagattataagtgtgagccaccatgcccagccagcaccagcttttaattgaaaaatattatagaacttaagagtcaggcaccattcttccttccaaatccatctttaaaactcagcttttcagaaatataactgcttttggtaaagaaaaaaaaattaagacttttaaattctgttccctagccacttcatgcctgcttatgtcttacctatgtagtttgcatcattggttcctaaacttgtttgcacgtaagaattagtctgactcttttagttctttttttttctttaatccggaagttcctgaaccagaataggttcagagatactcccttttagttctttttaatccataggttctgcctccatcacctccccacctttttttttaatttttttttttttttgagatggagtcttgctctgtcacccaggctggagtgcagtggcgtgatctcagctcactgcaacctccaccgcccgggttcaagcaattctcctgcctcagcctcctgagtagctgggattacaggtgcctaccaccatgcccggctaatttttgtattttttgtagagacgggtttcaccatgttggccagggtggtcttgaactcctgacctcaggtgatctgctcacctcagcctcccaaagtgctgggattacaggtatgagccactgtgcctggcccaaagtcacttttagcttcaaaaatgagctgtagggtatgccttcttttcctgtttccgtggattgtttactaaggtttgaatttttctgtgactggtagaacctacaagtcatttgaacctgagttttcataagaacaagccattttaaccccatcttctttttggttagagtttaaccccatcttctttctggttagagttactaaactggtaaataagagtgatccggccaggcatggtggctcacaccttgccagcactttgggagactgaggcaggcagatcacctgaggtcaggagttcaagaccagcccggccaacatggtgaaatcctgtctctacaaaaatacaaaaattagccgggcatgatggtggtacctgtaatcccagctagttgggaggctgaggcgggagaatcgcttgaacccaggaggcagaggttgcagtgagccgagatcgcgccattgcactccagcctgggcgatggaccaagactcattctcaaaaagaaaaaaaagagtgagccattgcatattgatttaaacaagacatctgataaagtctcatgtatttttgaaaaccgtgtcctgtattgtggtgcttaaaacaccaatggaaacatttgtctcagggtggttggcatttcctgcacaggttcttcatgaggtgccagagatacagaaatgaatgtgtgtgcctcttttcacacatgcacagatggctctccaggcaggagctctgcatgctaacacatgcctccctggtgcctagagcagtgcttggcctttgcatggtggtgcaggggcaggcaggttgatgcttatggagaatggctgaatccaccatgtccatctttggaatctatcagaagtttattgtttgcagctccaggcagggtctcctgaggatgcaagggagcaccaccctgggcctgcctgttgggcacctaacttctgagaggaggagggttggaacaagtccacaaataaccatatttttcccttttttggacatagggtcttgctctgttgcccaggctggagtgcagtggcacaaacatagctcaccacagcctcaacctcactggctcaagtaatcttcctgcctcagcctctttagtagctggggctacaggcatgtgccaccgcacctggctgatttttaaaatttttttggcagggcgcggtggctcgtgcctgtaatctcagcacgttggaaggccgaggcaggtggatcatctgaggtcaggaattcaagaccagcctggccaacgtggtgaaacaccgtctctactgaaaatacaaaaattagccgggcgtggtggcgcatgcctgtaatcccagctactcgggaggctgaggcaggagaattgcttgaacctggtaggcggaggctgcagtgagccaagatcgcgccactgcactccagcctgggcaacaatgcgagactctttctcaaaaaaaaaaaaaaaaaaaaatttttttttgtagctttgcacagcggcagtattgtagccaatgagatttatctgaggtgtgattattgataattgaaaacttttcccaataccctgccgtgatgacttgcaatatagtcagcactggcaatttttgacagtctctacagagactgaaaacaaaaattttttttatagagatggggtctcactttgttgcccaggctggcctcaaactcctgagctcaagcagtccacctacctcggcttcccaaggtgctgggattacaagtgtaaaccaccaagcccagcccacaaatcatctttagacaaattgtctaatcatctttagacaatactgaggtgcaggccttgtgtctgttggtggtgggaaagagatggttgactagggccttaaagataataaaaataattaacgtatgtatacagcaggggtggcttcctgctgtggtcactccagcgttgggtgaaagtgttccagcctggatagctctcccatctcgttggcattcctgaaattaggagactgttttcattgactttctagtgtttgcccttctggtggattatccttcttttatattgctggatcgggtttgcggatttgtctagcatccatgtagaatagggggctggggaccctaaccctcagtaaatatgaagttcctgactccttctcagatgggaactcaaagcctttatagaactgagagttagaacaggaagcaagaacgctaagagcttgctaacatttttctcttcattattccctggtggtttccccatggtagctttgtgtcatgtacgggcacttccaggaatagggtgcaggagaaacgtctcagtgtctccccttccgaatcttggcttctggagggagagatgctggggtgggagtgctccttggtggagtactcaggagcttagtaaaagcagagggggctggagaggcaggcctggcctgcagagccagcatggagaagcctggtgtagggctctccagcctgccaatttacagttaagaagaaaggagatatgtatatatatatatacacacacatacatacatacatacacacacacatatatacacacatatatatacacacatgtatacatatatatacacacacatacacatatacacacacatgtacacatatacacacatatatacgtgtgtgtgtatatatatatatatgtatacgtatatatatatgtgtgtgtgtatatatatatatatatatatatatagtgacagggtctcactctgtcacccaggttggagtgcagtgacacgatcttggttcactgcaacctccgcctcccaggttcaagcaattcttgtgcctcagcctcccaagtagctgggattacaggtgcacaccaccacgcccagcttattttttggtattttaagtagaggcggggtttcaccatgttggccaggctggtctcgaactcctgacctcaaatgatccacctgcttcggcttcccaaagtgctgggatgacaggcgtgagccaccgcgcccggctgaaaaaagattttcacaagaaccggaaggttaactcccctcccagacccaaagatgcagattcggcctgaccagtaggaatgcacatgtgcctctctgtgacaagggcagaactgaggctgcttctcaggagactgtgagggtctagcgtgccctccccgcagacatgagggccggatggaagagccttctgtccccagcatagccaatgggacaccatgaatcataggcttgtactgtggaaactagcaattatggtaattattcgcactacaaagggctcttcctcttaccaaaggacattttcctcccccaagctgcttgtcctcgcttttaaatagtagctcctccgtgaataaaggcagaaacatgtggttatagggaagaacaaaggaagataacatctctcacattataatggcaaacaatgatttgaaaatatcggtacaccagctttatccgtaaagcagtttatgtgagtgataactggtagataaatatggaaaagtagccgaacacacttgacacctctctgagcttgctttgtgatatgtgggcagctagaaaaagcagctaattattaggtggctcctttaacatttcctgatggggagcctgtgagcagaaaagagcgggtgcagccctggacagtggtcatgcacggttagcgcgaaacccactgagctgcagacacccgggtcagctcggaggagggaaggagtcgccgtcctgggccacagtctaggggggtggaccgtggtgccgtccctttggtgggactcaccttagtttctaccaacagctaaatatcacagatgcaaagacttgggggagaagcccatgaacattttctgagtcctttaatgtatgataaggaaaaaaataataaaagtcaacatttgtagaaatctaggttttggttttttgtttgtttgtttttttttgagacggagtctcgctctgtcgcccaggctggaatgcagtggtgcgatctcggctcactgcaacctctgcctcccaggttcaagcaattctcctggctcagcctctcatatagctgggactacaggtgccggccaccacgcatggctaatttttgtatttttagtagagatggggtttcaccatgttggtcaggctggtctcgaactcccgaccttaggtgatccacccacctcagcctcccaaagtgctgggattacaggcgtgagccaccgcacctggctagaaatgtaggttttatttttttaatgggatatttggtgattgtatatagtttttagactgatgggtaaaatgttgaaggtctgtattgcaatcctgcctttactttctaaaaaggattcctaaattgatccagcatcaaatcagtgtattttaaccctgacgatgagcagtatagtttcaggtcttgaatagcagggtccccccactataactccctgacagttcttcttgcccattgcacaaacaaaaccagttcatggagaccatggcattgcagtaaagaaagagtttagggccaggcacggtggctcacgcctgtaatcccagcactttgggaggctgaggcaggcagatcacctgaggtcaggagttcaagatcagcctggtcaacatggtgaaaccccatctctactaaaaatgcaaaaattagccgggcgtggtggcatatgcctataatcccagctactcaggaggctgaggcaggagaatcgcttgaacccgggaggcggaggttgcagtgagccaagatcacaccactgcactctagcctgggcgatagagcgagactccatctcaaaaaaaagaaagagtttaattgatgtgaggccagccatgctacatggaagagttattactcaaatcagtctctcctcgcatctgggggctagattttttcaaaaatagtttggaggaaggggtggaggtggctaggcaatgggtgcttgctgccgattggtctgggtgcaatcacaggggtgtgggactcatcctcctgcatgccgagtggcttctgggcgggtccaggaggagccatcacgttggacttgcaaaaaacctgaaaagatatctcaaaaagccaatcttaggttctgcaatagagatgcaggagtaattggagaagttgcagatcttgtgacctctggaatgatggctggcaccttaccagaattcagactcctcacctcctcctagcctggtagggtctctcattagcttaagaaagcttagctccatcctggctaacagggtgaaaccccatctccactaaaaaatacaaaaaaattagccgggcgtggtgatgggcgcctgtagtcccagctacttgggaggctgaggcaggagaatggcgtgaacctgggaggcggagcttgcagtgagccgagatctcgccactgccctccagcctgagcgacagagtgagactctgtctcaaaaaaaaaaaagaaagcttagcaaaggtggttgagtttcgggaaagggctgttattatttaaaccagaaactaggccctgtgtggtggctcctacttgtaatcccagcactttggctgagatcacgccactacactccagtctggcaacagagcgagactccgtctctaagtaaataaataaatccagattgtacattttataatactagagattcattttgtcatatgttaatccaatttactttgttaaaggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtaagtttaagttttagatcagaacggaagggtgcggtggctcacgcctgtaatcccagcacttcgggatgccgaggtgggcagatcacgaggtcaggagatcgagaccatcctggctaacacggtgaaaccctgtctctactaaaaatacaaaaaattagcccggcgtggtggcgggcgcctgtagttccagctactcgggaggctgaggcaggagaatggcgtgaacccgggaggcagagcttgcagtgagcggagattgcgccactgcactccagcctgggtgacagagccagactcgtctcaaaaaaaaaaaaagaaaaaaaagttttagatcagaatgagaaataacacagttggccacttgagggtgctaggtgtttagtatattgctttgctatttgttacgtggtagtactgggtctcagtccatcccccgcactgtatgtacatatatgcatatagttttaaaaactaatatgtaactgtatataagaaatggtcattcgtagaaccacagatcttgagactttgaaggatgcaatgtgtgagcagcagagccagaactagaagtacatgttttacacacataggtgtgtgtgtttatctttatgagaataccggtttttttaggtggggcatgatggctctgcaatcccagcactttgggaggctgagaggggtggatcacttgaagccaggagtttgagagcagcctggccaacgtagcgaaaccttatctctactaaaaatataaaaatgagccaggtgtggtggcatatgcctgtgatccccatgacttgggaggctgaggcacaagaattgcttgaacccaggaggcggaggttgcaatgagccgagagcgcgccattgcactccagtctgggtgacaggagtgagaccctcaaaaagaaacccgtttttgtgatgtgttgtcattcttcctgagaattcaaaaaaaaaaaaatttttttcttttttgagacggagtctcgctctgtcaccaagctggagtgcagtggtgcgatctcagcttactgcaccctccacctcccaggttcaggtgattctcttgcctcaccctcccgagtagctgggattacaggcacacacctccgtgcccagctaatttttgtacttttagtggagatgggatttcactctgttggccaggatggtcttgatctcctgacctcgtgatccgcccacctcggcctcccaaagtgttgggattacaagcataagccaccatgcccagcagagaattcaaaattcttaacaggatacttataaataaactgtgtaagaaagaagtataaatagtctaaaccagaagaaaaacatttaacttttttttttttcttctgagatggagtttcactcctgttgcccaggctggagtgcagtgacatgatctcagctcactgcaacctccacctccctggttcaagcgattctcctgcctcagcctcccaagtagctgggattacaggcgcccgccaccacacccggctaatttttgtatgtttagaagagatggggtttcaccacattggccaggctggtcttgaacccctgaccttcaggtgattcgcctgccttggcctcccaaagtgctgggattacaggcatgagccatcgtgcccggcaacatttaaactttgactttccatttgagtgggctatgtctggtggggtatatttatcatattctgtggagggttttttttgttgttgttgtttttgttttgagacagagtctcactctgttgtccaggctggagtgcagtggcgtgatctcggctcactgcaacctccgcctcctgggttcaagcagttctcccgcctcagcctcctaagtaggtgggattacaggtgcccaccatcacattgggctaatttttgtatttttagtagagacggggtttctccatgttggccaggctggtctggaactcctgacctcaggtgatccacccacctcgtcctcccaaagtgctggcattatgggtgtgagccactgtgcctgacctattctgtggatttataaacaaacagcgtctcccaaagtttattgaacatcttctcaaatcctgtttcaagcacaaaacttttaaccacattcagagggttttaaacgagctttgagatgggtcactagcttctcagaaaatccacatctaaacttctccagtacaccgtgagctgtgctctagccaaagaaaaatggaaagacagagaaaggagttctgagagcctttttttttttttttttttttttttaaggaaaaagaagaatttattcactcaagactaaaaactaaaggcctgggcctgagaactgaatcaggttagtgtgtttgtttgattgttttttttgctttctttgcgtttgagctagtccatgaaaagggaaaggaagggcggtgagagaggtggggaagttcagggcggtccttggcctgctttggggcagtgctcggcacacccctgtccaagttctcttgcacacccagttcccaggcatggctctccaatctcagctccctcctttctctccggattttaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcacccccatgccaggacctctgttgctatttgctggctgctggagaggtggggtcttgcgggccctggagaggtggggtcttgtggggcagagctggagcagatgctgcatccagcagtaagcatgagaatgagcactcacagttttgggtcctgtgctggacactgtgcaagtcctgtgcatatatcacctgttgcatttcccacagtgacccaatgaagtagatactgttatctttaccattttatagatgagcaacctgaggcttcaccagaattgcacagtgagaatgtggcgtggcctggattctcacgtcgggagtcggattgcaaagccttactgggcctcgccgcgccccatggctgtcagcgcattccatgctgacctggccgtgtatgcgtgcgtgtgtacgcatgtgtgtgcgtacgtgcacgtgtgtacatgtgtgtgtgcttgtgtgcacaccacatgtgccgtgtccataggtctgtcatcatatcaggtaggactaggtcggctcatagcttggaagggctttggagacagccactctcctaacagatgggagaagttgttttgattcttactaaggtcccagaatcctattgatggctttgctgagtattgaaaggctggccttaaattaggtttgaaactgaatttggtaataggacaggatgtgttaaggaagggaaacatacagggagctgcctgctctggcagctgttgaaagtgagcaggccacggtgcctgcagtgggagtggggcagcaggcgtgtcaccttgggccagagcacatgtcttgtacacggttgcaccaatgcgtgaggatgtaggtccccaagagccaagagaaggggagctttgttgaatacgtgatattggagaaagctttggcccaaaagaacaaatttagattcgttctctctgcaatacaaatgtattccagtgggtcaaaatgttaattattattaatttctttttttgtttcttgagtcagggtctcactctgtctcccaggctggaatgcagtggcaccatctaggcttactgcagccttgacctcctgggctcaagtgatcctcccacttcagcctcccaagtagctaggactgcaggtgcacgccagcaccacacctgcctaatttttgtgttttttgtagagacggagttttgccgtgttgcccaggctggtctcaaactcctgagctcaagcagtccactcacctcatcctcccaaagtgctgggattacaggcgtgagccactgtgcctggccaaaaagttaattattaaaagtcaggccgggcgcggtggttcacgcctgtaatcccagcactttgggaggctgaggcaggggaatcacaaggtcaggagttcgagaccagcctgatcaacatggtgaaaccccgtctctactaaaaatacaaaaattagctggtcgtggtggcacttgcctgtaatcccagctactcaggagactgaggcaggagaatcacttgaacccaggaggcggaggttgcggtgagccgagattgcgccactgcactccagcctgggtgacagagcgagactctgtctcaaaaaaataaaaaaagaaagtcgattgtttatggattaaagagttagatacatagttcgcagctgtagagcatctaataggatataacagactcaccattatctggaggaatgataccgtcctgagcttgagggtgaagacagagatattcaagaacataaaagctgaaaacgtctgtgttaagactccttttgatccaggtttctggacaggagagtttgctgagcatatgtggaggtggctcagtacccagaggcgggtggagctggccccagtcatggcctgtgctcagacgctaggaccagagcaatttcttcctcatgtttaaacttttctcctaggccactgccttacctttctcatgctataaactggctttctctgcctccttgtttatccctcctaagttcaaagaagcagtcagctgaggaggctgcctttcctcaggctggctccagcccggttgggaggtgcccggattagctgaggcagaggtggggcttgtgcagagagcctggctgctgccatggagacgggaggaagcaggcaaaagagcaggcctgctggcaaaggatcagagggctgggtaggcgcagggatcagtgtcccggaaatgtgaggaagggcaagtgctggcagcaaaacaacatgggcaatttggacttcaggaaaagctgccacaaatactcagaaataacacacatttatagacaaataacgtgactacaagaagaaaaaattgttcaaactctaaattttacaaggcatatttgtttatttttttgagatggagtctcactctgtcaccaggctggagtgcagtggcgtgatctcggctcactgcagtctccacctccgggttcaagcaattctcctgtctcagccttccaagtagctgggattataggcacccgcccccacacctggctaatttgtgtgtgtgtgtgtgtttcgtagacggagtttcaccatgttgaccaggctggtctcaaactcctgacctcaagtgatcttctcatctcagtctcccaaagtggtgggattacaggcatgagccaccgcgcccagcctacagtgcatatgcaacaagaagtcatcatttcatgcttactcagttcatgggggaatgttttcagtcttgagactcagtgctggcggagttacatcaaaggtggatggcagcagaaaatcctcagccccttttccagaagaatttagctacacatatttacatataccccaggaagcaggcaaatgatgctcatgaatcatctctaagaattcatgtgagagccaggcttggtggctcatacctgtaatcccaccactttgtgaggctgaggtgggtggatcacttgagcccaggagtttgagaccagcctgggcaacatggtaaaaccctttgtctacaaaaaatttaaaaataaaaataattaaggccgggtgcggtggctcatgcctgtaatcccagcactttgggaggctgaggcaggcggatcacctgaggtcaggagtttgagaccagcctgaccaacatgaagaaactccatctctactaaaaatacaaaattagccagtcgtggtgatgcatgcctgtaatcccagctactcaggaggctgaggcagaagaatcgcttgaaccccggaggcggaagttgcactgaaccgagattgcaccattgcactccagcctgggcagcaagagtgaaactccatctcaaaaaaaaaaaaaaaaaaaaaaagccaagtttggcagtatgtgtctgtagtcccaactactcgggaggctgaggtgggaggatcacttgagcccagggggtggaggctgcagtgagccgagattgtgtcactgcactccagcctgagtgacagagccagactgtctccaaaaaaaaaattcatgtggggaaacatgggaagagttcagctgtgtgttccttgcagcacaatctttcattgcagaagaatgggaagaatggaaatgcccagtactagaagaacggataaggctgtggtggcctacgcacttactggccttcaccggaatattctgcagcagtgcagaaaaatgagtgattgaatttgaagtgcaagcagcagaatactgtgatttcagttctgccagtctcaaaattaaatctcatttgtaaggcaggcagtattgtgggagaattcctctaatgtatttcattcccagagtgtttatgcagtggcaggaagagtaccatcaagatgggtttagtttaagtcagtctcctaagtatttatgaaacacccactcggttttcagtaagtgtggtgaactcggtgttttgcctctttccctgaacttagcggtaggttcggtattaagctgcagtgctgcagtgtggatggtgccctgcttagcagatattacagtgcttctgctgcttgttgagccttggcctgggggtgtttgagccaaatgcaaggagacctgtcctgagggacgcccatgtcaatggagtcaggtggcagcagctggtacccctgcctttgggatactcccgtggtcaccctaacagcagtgaccacaagcaagcacttctgtgccagccgcgcccctcctgccacactgacggagtgtagcttcatgaggtgcgcggttgctgtcacacactagagaggaagaaactgagatggaggtaagtcacagctctggggccacacagccaggtggggacagtcttggcctctgtccatcccagatgaggtctcgctatgttgaccaggctggcctcaagcagtcttcctgcctcaacctctgagtacggacacagttttgagcgccctatatgtgtattaacagtaacacatgagacagagtaggccctctttatccgagggatacattccaagacccccagtgaatgcctaagactgaggctagtaccaagccctgtatgtacactaggtttttccctacacggttgtccctcccctatgtcctcagttcaaccaaccacagattgaaaaatattgaaaacaataaacatataaacaataaaatattgaaaataaaaaatacaattttttctttttagatggagtctcactctgtcacccaggctggagtgcagtggcacgatctcggctcactgcaaactctgcctcctggttcaagcgattctcctgcctcagccttctgagtagctgggactacaggtacacaccaccacacctgactaatttttgtatttttagtagaggcagggtttcaccatgttggccaggctggtctcaaactcctgacctcagatgatccacccacctcggcctcccaaagttctgggattataggcatgagccaccgcgcccggccaaaaatagaaaaatttagaagtacagcataacggccgggcacggtggctcacgcctgtaatcctagcactttgggaggctgaggcgggcagatcacctgaggtcaggagttcgagaccagcctggccaacaatgtgaaatcccgtctatactaaagacacaaaacttagctggacgtggtggcgtatgcctgtaatcccagctacttgggaggctgaggcaggagaatcatctgaacctgggagatggaggctgcagtgagccgagatcatgccactgcactctagcctgggcaacaaagcaagactctgtctcaaaaaaaaaaaaaaaaaaagtacagcatgacaactgttcatacagcatttacattgtattaggtatcataagtaatccagggatgacttaaagcatatgggaggatgcgagtaggttatttgcaaatatttggagacaaagccttgctctgccactcaggctggagtgcagtggcgcgatcgtggctccctggagcttcaacctcccaggctcaagccatcctcctgcctcagcctcccaagttgctgggactacaggcacatgccaccatgcctcgctaatttaaaaaaaaatttttttgtagaatttttttctatgttgcctaggtttattacaacattatattttattttatttatttttcgagatggagtatcaatctgtcacccaggctggagtgcagtggtgcagtctctgctcactgcagcttccgcctctgggttcaagcaattctcctgcctcagcctcccaaatagtgaggactacaggcatctgccaccatacccagctaatttttgttttttgttttttgtggttttttttgttttttgaagcggagtctcactctgtcgccaggctggagtgcagtggccctatcttggctcactgcaacctccacctcccgggttcaagcaatcctcctgcctcagcctcctgagtagctgggactacaggtgtgtgctaccacaccaagctaattttttttgtatttttagtagagatgaggtctcccatgttggccaggatggtctcaatctcttcacctcagatccacccacctcagcctcccaaagtgctgggattacaggcgtgagccactatccttggcctgttgttttttttttttttttgagacggagtttcattcttgttgcccaggctggagtgcagtggcgcaatctcagctcactgcaacctctgcctccttggttcaaggaattctcctgcctcagcctcctgagtagctggcattataggcatgtgccaccacgcccggctaattttttttgtatttttagtagggatggagtttctccattttggtcaggctgttctggaactcccaacctcaggtgatccgcccgtcttggcctcccaaagtcctgggattacaggcgtgagccaccgcgcccagcctgttacaccattttatataaaggatttgagcatcctgaaatgttggtatctgtaggagtcctggaaccaacctcctatcgataccaagggacaacttttcatttttagctatgataaagtttataaattaggcatgagagactagcaatgataactaataaaatagaacaagtgtaacaatatgccagcatctctaatcttgtattttgcaaccattaccaagtaaataagggttactcagacacaagcactgctgtacgacgacagtggatctgatcaccgagacggctgctgagtaactaacgagtggggcgcgtctacactgtggaggtgctggacagagggaggagtcgcctcctgggctggtcggagtaggaccttgggaggtttcatcacgctactcagaacagcatgcagttcaaaacttatgacttgttcatttctggaattttccatttaatattttcagaccccactttacctcgggtaactgaaaccatggaaagaaaaaccatggatggaggggacagctgtgctgccgccatctcccttacacagttgagtaaaccgaggcacagaagaaaatgaagtagccccagatgacgtaggaaatggcagaactgaagggaaaagcagagcagggggctgtagagttaaactgttcttcattccggtggcactagacctgcccgggcggccagaggacacgtggctcctgtcctgtctgccgtgtggctaggggacagccgtgcttgtgctgtgccgtctgagtgtttgtttctgtctgtgggaataaaggggttgccagacaccctccctgctctgtggagggagggtggaatcatgcctttggccactttgcccactcccccttgggccggagcatcagcattagctgtgccacagggtggtatgcgctctgctgaaggtggcaccttcagggaaaggcagtctgccggggaggctagcgagcaccctgggtaggagctgagcgtggcctccgcgcctcctcatgggaagtgctggagatgcaggagcccctgagccagagcccagcgctcttacaagagacctcacttcctgttcggggactggggctgctaagtcagagtgcgcctcctgcacccgccaccctggatgtggttccattccctggtccctgagccatagctggggggcatgagactgtcccctgggctgctttggggaccctacttcagggcagccctgccactccctgtaacgggctgtgggtcctgccctgtggccttcctacctctcttgcgtgtgggtgagcctgagcgtggccaccgccctgggagtgccacagaggcaagcggcactggtcctcatgtgtaaacagccccaccagcacgcggggctggagtagtcaggccgggacctgtcccaggaatgggcaggctgttaacctaggatgcattcaagttaggacacatttcattcccgtgtagcggtggctcccagttcctccgcagaacctgcaggagtgtgcgtgatgaaacccgtcactcgttgtgtatggtagacatacctgcctgggtcgtaatcacttgtgaagaaaatgaattatgctgtgacctttagatacgattcacataccataaaattcaccctgccttttttttttttttttgagatggagtctccttgtcgtgccctgcctaaattcacccttttaaactgtataattccatggcttttagtagtcacaagattgtacaactacatcactaattctgaacattttcatcacctcaagaagaaaccccacacccattagccagtctcaattcctgcctcacctaaccccggcagcccactttatatctctggatttgcctattctgaacatttccagataaatggaatcatacaatatgtggtcttttgtgtctgcctttttttcacttaggttcataatgttttcaagatttatttatattgtctcatgtattagcactttggagatttttttaatggctgtataatattctatacggatataccatgttttgtttatccacttactagttgatgaacatttggattatttctaccctttggctattatgaattatgctactgtgaataatcctgtgtatacctacaggtgaactgctgagttaagagtctttttggcctggcgcggtggctcacgcctgtaatcccagctctttgggaggccaaggtgggcggatcacttgaggtcaggagttcatgaccagcctggccaacatggtgaaacccgatctctactaaaaatacaaaaaattagctgggtgtggtggcgggcgcctgtaatcccagctactcgggaggctgaagcaggagaatttgctggaacccgggaggtggaggttgcagtgagccgagattgtgccattgcactccagcctgggcaacagagcaagactcgatctcaaaaaaaaaaaaaaaaaaaaaaaaagagtcttttttcctcctgagaccaaatacctggtgtcttctctaattccacttctccaactcctcaacaccagctataggtgtccagcaattcagttcaattctgacactgtctacttggagttcatgtctgatgccacaggttaaagacccagtcccacaagattgcctccactgaggcagtctttctctttggataaattcctgtttacatcctttgccggttgccagtcctgggccacttgtccctctgcctgacaggctataaatcagactatgaccccctccacaggattgataatttgctagaatggatcacaacattcagaaaggtgttttacttactcttagcggtttattattaaggatacaactcagggacagccagatagcagagatgcacatggcaaggtatgggggcatgcggagcccctgcgccctctctgggcatgccatcctcccagcaccttttgtttgtttgtttgtttttttgagcaggtctcactctgtcgcccaggctgagtgcagtggcatgatcatggctcactgcagcgtcagcctcctgggctcaagcaaccctccctcggccccacaaagcactgggataacaggcgtgagccaccgtgcctggcctcccagcacctcaatatgttcagtagcccggatgctctctgaaccccatggtttagggatttttatggaggtctcatgaggtaggcatggttgattaaatcattggccgttggtaattagctcaatctctactccctctcctttccccaaaactgaaagttttgagcttccaatcaaggcttggtctttccggcccccatcccgaagcagtacaggagcccaccagagctgccccattcgaacaggagcagctgctatcacccttcatcactcaggagattctgaggttttaggagctctgtgccaggaacaggggacaaagaccaaatacctctctataatgccacgtgggtcttatgatcacgaactctgtgtttaactttttcaggaattacaaagctgtttttcagagtggcctgacctatttttttatttccaccagcaatgtatgagagttctaatttctctacatccttgtcaacacttgttattgtctgtgtttaataatagctatcctagcgggtgtgacgtggcatgcctttgtctttctgatttcccgtggtgttgagcatcttgtcatgtgcttattggttgttcgtgtatcttttttggagaaattcctgtttaaatcctttgcccattttaaaagtggatgatttggccaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaataggatgatttgtctttttgttgctgagataaaaagagttcttggccaggcgcggtggctcacgcctgtaataccagcactttgggaggccaaggcgggtggatcacctgaggttgggagttcgagaccagcctgaccaacatggagaaacccgtctctactaaaactacaaaaaattagctgggcgtggtggcacatacctgtaatcccagctactcgggaggctgaggcaggagaattgcttgaacctggcaggtggaggttgtggtgagccgagatcgtaccattgcactccagcctgggcaacaaaagcgaaactccgtctcaaaaaaaaaaaaaaagttatttacatattctcgatactagacctttattagatggatgattagcaaatgtttttctcccgttctataggttttttctctttttttttttttttttgaaacagagtctcgctctgtcgccaggctggagtgcagtggtgtgaactcggctcactgcaacctccacctcccgggttcaagcaattctcctgcctcagcctcccgagtaactgggactacagacgcacgccactacacccggctaatttttgtacttttagtagagacggggtttcaccatgttggccaggatggtctcgatctcctcaccttgtgatccacttgcctcggcctcccaaagtgctgggattacaggcgtgagccaccatgcccggcccggcccttttttgttgttttttgtttttttttgttttgtttttggagacggagtttcgctgttgttgcccaggctggagtgcaatggcacgatctcggctcattgcaacctccacctcctgagttcaagcaattctcctacctcagcctcctgagtagctgggattacaggtgcctgctaccatgcccggctaatttttgtatttttagtagagacggtgtttcagcacgttggccaggctggtctcgaactcctgacctcaggtgatccacccacctcagcctcccaaagtgctgagattataggcgtgagccactgcacctggccttttttttttttttttttttttaacgagacagggtctggctctgttgcccaggctggagtgcagtggtatgatcatggctcactgcaaccttgaactcctgggctcaggtgaccctccttccccggcctcttgagtagctaagactacaggcatgtaccaccatacctagctaatttttttattttttggagagatgaggtcttattatgttgcccaggctggtcttgaactcctggtcccaagtgatcctcctgcctcagcttcccaagtagctgggactacagacgtgcaccaccacgcccagctaatttttgtatttttagtagagatgaggttttaccatgttggccagaatggtctctatctcttgatcttctgatcggcccagcccggcctcccaaagtgctggaattacaggcatgagctatcacgcctggccttttttttttttgattcggagttttactcttttgcccaggctggagtgaagtggcatgatctgggctcattgtaacctctgccaccccccaccggccccagtatttttagtagagacggggtttcaccatgttggcccagctggtctcaaactcctgacctcaggtgatccacctgcctcggcctcccaaagtgctaggattacaggcgtgagtcaccacatctggctaatatttgtatttttagtagagatggggtttcaccatgttggccacgctggtcatgaactcctgacctcaagtgatcctcccaccttggcctcccaaagtgctgggattataggcgtgacccactgcacctagcctattttgtatttttcagtgtacacatcttacacgtctcctctcaaatttattcctaagtcttttattatttttgatgctatcataagtagaattgttttcttgatttcatttcagactgttcattgctagtgtatagaaatacaattgatgtttgtatattggtcttgtatatatcctgcaagcttgctgaactcatttattagctctaatagttttttgtttatcctttctccttaagtcttaatgtttaagctgaaattacctttcaggtcagaaagcaacattgaatgcagaagaaatggcggacttctacaaggaatttttaagtaaaaattttcagaagcacatgtattataacaggtaggtgtttactcttttcctgaaaatttgaatagcacatccagattaggtaggagtgttttcttacctgaatttaacaacattcatgtttatatcagaggtagaagttgcaagactttatcaacttttttttttctttttttctttttttttttttttttgagacggagtttcgctctctcgcccaggctggagtgcagtggcgccatcttggctcactgcaagctccgcctcctgggttcacgccattctcctgcctcagcctcccgagtagctgggactacaggcacccgccagcacgcctggctaattttttgtatttttagtagagacagggtttcaccgtgttaggcaggatggtctcaatctcctgacctcgtgatccgcctgccttggcctcccaaagtgctgggattacaggcatgagccactgcgcctcgtctatcaactttattttttaagtgactgcagtggcttaaaaagataccaatttttttaggtcgggtgtggtggttcacacctgtaatcccagcactttaggaggccaaggtgggcagatcacctgaggtcaggagttcaagaccagcctgaccaacatggagaaaccctgtctctactaaaaatacaaaattagccagctgctccggaggctcagtcaggagaatcgcttgaacgtggaaggtggaggttgcggtgagctgagatcgtgccattgcactccagtctgggcaaggagaacaaaactccatctcaaaaaaaaaaaaaaaaaaaaaaaacgggttttagctggttacagataataatgacctgtatttacaggtgaaattaataggacatgatatctgagatttgctttaaaatatttgtaggctggatacggtggctcgcacctggaatcccatgactttgggaggccaaggtgggtagatcacttgagtccaggagttcaagaccagtctgggcaacatagtgaaaggcttgagctaggaggaccacttgagcctgggaggttaaggctacagtgagccgagatccggccactgcattccagcctggatggcagacagagtaagaccctgtctcaataaataaataaataagtaagtaattaaaaaaatatatatatatatataaaacagttccagagttacaaagcctgatgggcaggtgaagccagacttcaagaatgtcgacatgggccaggcacggtagctcacacctgtactcccagcactttgggaggccaaggcagatggattgcttgagcccaggagtttgagaccagcctggacaacatgacaaaaccctgtctctacaaaaaatacaaaaattagcttggtgtggtagtgtgcacctgtaatcccagctacaggaggctgaggcaggaggatcccttgagcccaggaggtggaggttgcagtgagccgagatcccgctactgcactccagcctgggctacagagtgagaccctaataaaaaaagagaatatagatacagtcaaaggctggatggactcagtgagggacagtctgacctaaagattagtcctgaaatatctggattccatttctaaggttgtcatgtattactctgaattagttaagtcattcaaacaagcgagtataatctttccctggtctttggacacgtagcttgtttgcacggggcacagtctctgatgggcttcatgttttctctgtggcactcgggtgaagaggaccagccttacccaagatcaggccttagaggagcctggcccccaccaccacctcctgcccctgccttccctgtggcaacagcagaagtgtagcttgcttttacatgtcatagaatcaggtcgtctgtattagtgaaatggaatatggcttttccttgaagaactgtaatccccatgggctaccggttttcttctcctggaagcgcttatttactttgggcactgctcctcatgacagcattgcttaagtaggtggaggtgtaaaggtggtttgcaggtggagaggaactttctgtcctgccatgcagagcctccagagtggtcgtggcccatcacatccctaaaatgctgccagctcggcaggcctggggtttccaagggctctcttggatcttttagcaaaaatcaaaggagtacttaagaggctgaggcagaagaattacttgaacccaggaggcagaggttgcaatgagccaagattgtgccactgtactccagcctggacaactaagcaagatgaaaaaacaaaacaaaaaaaactccaaaggaggggccgggtgcggtggctcacacctgtaatcccagaactttgggaggttgaggcaggtgggtcaggagatcgaaaccatcctggctaacacggtgaaaccctgtctctactaaaaaaaaaaaatacaaaaaattagccgggtgtggtggcgggcgcctgtagtcccagctactcgggaggctgaggcaggagaatggcgcgaacccgggaggcggagcttgcagtcagccgagatcgcgccactgcactccagcctgggcgacagaccgagactccgtctcaaaaaaaaaaaacaccaaaggaggatggtggcggcctccagaaacagggctggagaggactccaggcgtcgccagtgggcctcactctcagcctgaggagaggcaggcctctatgaatagtttagctttaacaagggcagggaaagggcaaagcagttgaggcctggtcagttgaactcatcctcaactgggagccacttctgggccagggcaccaagcctcagtccctgccaccgtgtcacctgtgcatcctctgtttctctacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaa

SEQ ID NO: 1289 - DNA, 5776 bp, Homo sapiens
agcctttctccactgcaagcgtaagagactggttttatttcaagaataactaagggtatattaacacatgtatctcaaagtaacattgaattattgaagacatactgttccaatactcaaacagttcacagagaggggacaggaaccaatgtactggaaaaacacacttgtattatatgtaaaaatcgatggccaatatttctcttattaagagaaaaatacccaacaaattaaaaggtgaaaagctgtgctcaaaaaaaaaataaaaaaacccaaaaccttgcatgcacaagctaagctcagacccttaaaaaccagatagaaattgacaaagtcaaacaaaggagaaaaactagctgaacttctcaaactaaattatatcaaatatatgtgcattttagcaaaataaaccactaaactatactttgtagacatattcattacatttattttaataactacttcattataggctgactggctttcctgtgtggataaagtgtgatctgaaagcaacgctgactgaatgtaaataaagcaaacgttcccagccatttttggcatgaacatggactacagcgtttaatgcagacccaaagccacacatttttggggagtaggttttacttgcagtacagattcttttcattacagatcacaaaaatacaatacaatgtgacaagcccagtttaagaattacatgcagtagctcatattaacacaaacagctccccacgaaggccgacaagagctaaatccggtgtcaacagggttcattgcaggagtagaataatccggtacaaggaacgagaacagattgaaaccagaaacaaagccatgcctgacagtcaatcaaggtcaatctgatcatttccatgaccaattacccatgtgaacaattcaaaatgacggtggaagagctgagcaccctgtactcacacacgatgcccacagcttggcaaaaggtacacaaacacttgtttgaaaagaatgactgaaacgtctactttcaaagaacaatggacacttttaaagggaatgctgacatttaactttacaaaatgaaatttaaaatgtaagtagtactctggggaagaatatgcctgaagcgtaaccatgatttcccagtggtataattaaacagagctctaatttaaaaactcttcctgggctgggcgccgtggctcacacccgttaatcccagcactttggggggccgaggcgggcggatcacgaggtcaggagttcgagaccagcctgaccatcatggtgaaatctcaactctattaaaaatacaaaaattagccaggcatggtgccacatgcctgtactcccagctactcaggtggctgaggcaggagaatcgcttgaacctgggaggtggaggttgcagtgagctgagatggcaccactgcactgcagcctgggcaacagagactccatctcaaaaataaataaaaaataaaaactcttcctcaagattttaagagcattctaaaattatgatacagaaaagcaatcctacaactactgtggccaaaacgtggattccaatgacctgccttgagcccgcggttgccaggagttggacctgcagtagtatgggaagctcacggcctaaataccgactgccctctgaccccaccgtccagcgattctagaacatttctagtaggaaagacatagcaagggattttcatgattgggaaatactgagagacaagctgaagatttgttaagggctatgcttctgtcatcttttaggtatttaaggctactcctttagctagctactttgagctgtttaaagtgactatctccctacacagagttacacaatgagcatctctgaaagagaatattaccctggatttccaaagatgtactctaacaggatgaccaggcaaaaggtgacccgggggaggagtctgttataacactcggacccacatgttctcaaggcacttcagaactttgggaaatcattttgtaccggatcctcagaaagcatttatggaaatacacatcctttagaagagagatgcttcacgcacgactgactttaatggctctttcaggcaacagagaaaccaccacatgcccatgacatgagctcagttgttcagcaggcacccagaggaagcctttaattccgagcaggtttcactgattggtcctggagcaggtgtagttatgacatttactaagtgagtggttaacagctgactgcctagaaaacctaggaaggcctggtccctctgggttactgacagcgtctaccctcacgttgtaaaacagcaccggggaggtgtgacaaggctgtccattttacagccttggacaacagaagagaaccattatgtgctacattcagactttctgatttagttttagtataacctgacattggtaacccgtctccagtattcatcctccaactacaggtatgagtgtttcctttttttttttttaaaggcccattaacttaatttaaatgttcccatccttatgaatttactcactaaggaaaactataagctcagattttacaaacaaaagcaacttacaaggtattattgctggtcctttatcccttctctttaatgcaatctcaaaggttttttggctattagttttcataattttcttatgttgcacacaaaaacaagattcctctctaaaacgtagaggatggggaaaatgcagatgctgtttttccaactaaaaatgtttacaaaagaacagactgtctgaacaaacaaaaaaaccccaccccgttaagctgggtaggaccaatcaggccttataagtgaaaaaaaagccttctatcgagcataatgaaacagaacatgtactgcttgtgtttgaaccttactcttatttaaccaaaaatttcccctttctcataattttcctagtattatgtaaggttatgcctagttctagattctgaaagacctgcattttaatgcttgcacaacccatttaaaatctacaaaagctgcctctattttgttttctgattaaaaacgcaaaaaaaaggacaaaccaaacaaaccacaccacatcatacagataatgatccgaatggaaaagttaacgtgctgtaatgatatttgtcttgcaacatcaaaagcagcagatactgaatagaatttgcttcaatcataaatactgagactgaaatatgcacgtataaatcaatgaactgaaagctctctatacatagaagcacatatgaagtgcaaaacagtatcaaaagtgagatctctggtatttcagtactcccattcatcagatttcaggtcgagatagctgagaatattctgcgcaagcctcacagcttgtttcctggcagccttacacttctcttctccctgcggatcaacagcatccagggctagcagctgcttggtgagcagctcttccagccggatgtagttcttatcggttcgatttccatcaaatgaaagaacttctccctggatctcagacaagtttccaaggacgttccagacggctttatgggatgggtgctcctcacaagcaaacagctttcttttctcaagggcctccttcaagtcaatatatgtgatcagagtttgcacctcgatcactgctcttctcctggcttcccggatgcaggggtttttttcaagacttacctcatccaactgtccaattaaaccctgcaattctgttttggagctcaggtacaattcagaagggttttgtgcttggagaagttcattttttatttctctcattctcttgaggaccttttctatttttaaaatggaatgattctgtctcaggtcaaatgctttagttgtgtctgcttcctcttccaaatccagatatttcaataatttgttgatatcttctactacctccctccgataatttctgatttctgtccggccgcacacatctagagcatccaggtcagcgatcagccccgagagcacacaggataagtgcctgcaggtctcattgttgttcacacccatcagaagtgcaatcaggacccctcgggccttgttcacctcacacatcacgaagttgattttggcaacggaaggatgtgcatcctcggaaagcggcagggaaggctgctttttcatgcagtcttcgattatctcttgcaccgcacagattttggttaaagtgtgataccttgctttccgcaaggagatttttcctccagttttaacatgtgtcagcctcagaatgatatcttggatgccttcttcaaactcatcagttacgcagttgcctccattataaaatggcacaattttctctctcacgagggactgggcttcctcaaaaatgttctgtatttcaatccggtgtgggtggtttgcattctgctccaactctttgagaagacgttctgtctcctgtgctgcccgcttcctagcttgctgaatatctccttttccttcagtatctacagagtctatttcaaaaagctgttttgttagaatcctctccagtttcttgtaattcttgtcatctgacagaccactgaagccgataacttgctgttctacactttttacttccttttggatttcctgaagcctactaatagaaggatgttggtttcccatatccatacttttgttgtgttcagtttcacaagcactaaaagacgacaagaatgataacttactacagcacaaggcttctgcagaacactaatggtatattaagtcattctaaaattctcattttaaaaaggtatacttctgagcagtcatcccacctcagcctccccagtagctgggtctacagtcgtacaccactacgcccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtgaaacagtagctcttgtaaccttccgaacactaacagtaccccgccccgccacacagctatgcctagtttccagaaactctaagcaaaagaaagaaccagaacaaaaaccagtggctctcagacatccccaaggtccccgcttcttcgtttctctccatccctttgtgcacttcccctccccacccttttagctcctcacacatcttccctcacagaagtctccctgaagagattaaaaccccacaggtaaagaagagcgaccgggacagcgctgaagggcaccaccttgggctttcgaggcccaacacctcctcagcccccaacatgctccactctctcaaaaaaaaacaacccgcgaaaacgtggtaactatgaataattcattcactcgcctcccactgggagtccacaatggcctaatgcacgtttcaagctcttggtttctatcaaacggctcgctcaaggtgggtaaccaatggaaacgcataatctatccccggcggatgtcctggaggccacggagggaaggcggcccgagctgcttcctccccgcctcgcccttccctcttggccctttacccaaaagaagtctgaattggatgcggtcttggcgtcccgtggctgaggtggcgaggtggaagatcagccctttacggggtgcggcaccggagctgggcccccagctgcatgcctcgcacccctcccgactaggtctgagcggggcagccggtgaaggggccgctactggctgcagcagccgctccgggcgtcttggcccgggtgccagggcgcgcctgc

SEQ ID NO: 1290 - DNA, 6272 bp, Homo sapiens
agcctttctccactgcaagcgtaagagactggttttatttcaagaataactaagggtatattaacacatgtatctcaaagtaacattgaattattgaagacatactgttccaatactcaaacagttcacagagaggggacaggaaccaatgtactggaaaaacacacttgtattatatgtaaaaatcgatggccaatatttctcttattaagagaaaaatacccaacaaattaaaaggtgaaaagctgtgctcaaaaaaaaaataaaaaaacccaaaaccttgcatgcacaagctaagctcagacccttaaaaaccagatagaaattgacaaagtcaaacaaaggagaaaaactagctgaacttctcaaactaaattatatcaaatatatgtgcattttagcaaaataaaccactaaactatactttgtagacatattcattacatttattttaataactacttcattataggctgactggctttcctgtgtggataaagtgtgatctgaaagcaacgctgactgaatgtaaataaagcaaacgttcccagccatttttggcatgaacatggactacagcgtttaatgcagacccaaagccacacatttttggggagtaggttttacttgcagtacagattcttttcattacagatcacaaaaatacaatacaatgtgacaagcccagtttaagaattacatgcagtagctcatattaacacaaacagctccccacgaaggccgacaagagctaaatccggtgtcaacagggttcattgcaggagtagaataatccggtacaaggaacgagaacagattgaaaccagaaacaaagccatgcctgacagtcaatcaaggtcaatctgatcatttccatgaccaattacccatgtgaacaattcaaaatgacggtggaagagctgagcaccctgtactcacacacgatgcccacagcttggcaaaaggtacacaaacacttgtttgaaaagaatgactgaaacgtctactttcaaagaacaatggacacttttaaagggaatgctgacatttaactttacaaaatgaaatttaaaatgtaagtagtactctggggaagaatatgcctgaagcgtaaccatgatttcccagtggtataattaaacagagctctaatttaaaaactcttcctgggctgggcgccgtggctcacacccgttaatcccagcactttggggggccgaggcgggcggatcacgaggtcaggagttcgagaccagcctgaccatcatggtgaaatctcaactctattaaaaatacaaaaattagccaggcatggtgccacatgcctgtactcccagctactcaggtggctgaggcaggagaatcgcttgaacctgggaggtggaggttgcagtgagctgagatggcaccactgcactgcagcctgggcaacagagactccatctcaaaaataaataaaaaataaaaactcttcctcaagattttaagagcattctaaaattatgatacagaaaagcaatcctacaactactgtggccaaaacgtggattccaatgacctgccttgagcccgcggttgccaggagttggacctgcagtagtatgggaagctcacggcctaaataccgactgccctctgaccccaccgtccagcgattctagaacatttctagtaggaaagacatagcaagggattttcatgattgggaaatactgagagacaagctgaagatttgttaagggctatgcttctgtcatcttttaggtatttaaggctactcctttagctagctactttgagctgtttaaagtgactatctccctacacagagttacacaatgagcatctctgaaagagaatattaccctggatttccaaagatgtactctaacaggatgaccaggcaaaaggtgacccgggggaggagtctgttataacactcggacccacatgttctcaaggcacttcagaactttgggaaatcattttgtaccggatcctcagaaagcatttatggaaatacacatcctttagaagagagatgcttcacgcacgactgactttaatggctctttcaggcaacagagaaaccaccacatgcccatgacatgagctcagttgttcagcaggcacccagaggaagcctttaattccgagcaggtttcactgattggtcctggagcaggtgtagttatgacatttactaagtgagtggttaacagctgactgcctagaaaacctaggaaggcctggtccctctgggttactgacagcgtctaccctcacgttgtaaaacagcaccggggaggtgtgacaaggctgtccattttacagccttggacaacagaagagaaccattatgtgctacattcagactttctgatttagttttagtataacctgacattggtaacccgtctccagtattcatcctccaactacaggtatgagtgtttcctttttttttttttaaaggcccattaacttaatttaaatgttcccatccttatgaatttactcactaaggaaaactataagctcagattttacaaacaaaagcaacttacaaggtattattgctggtcctttatcccttctctttaatgcaatctcaaaggttttttggctattagttttcataattttcttatgttgcacacaaaaacaagattcctctctaaaacgtagaggatggggaaaatgcagatgctgtttttccaactaaaaatgtttacaaaagaacagactgtctgaacaaacaaaaaaaccccaccccgttaagctgggtaggaccaatcaggccttataagtgaaaaaaaagccttctatcgagcataatgaaacagaacatgtactgcttgtgtttgaaccttactcttatttaaccaaaaatttcccctttctcataattttcctagtattatgtaaggttatgcctagttctagattctgaaagacctgcattttaatgcttgcacaacccatttaaaatctacaaaagctgcctctattttgttttctgattaaaaacgcaaaaaaaaggacaaaccaaacaaaccacaccacatcatacagataatgatccgaatggaaaagttaacgtgctgtaatgatatttgtcttgcaacatcaaaagcagcagatactgaatagaatttgcttcaatcataaatactgagactgaaatatgcacgtataaatcaatgaactgaaagctctctatacatagaagcacatatgaagtgcaaaacagtatcaaaagtgagatctctggtatttcagtactcccattcatcagatttcaggtcgagatagctgagaatattctgcgcaagcctcacagcttgtttcctggcagccttacacttctcttctccctgcggatcaacagcatccagggctagcagctgcttggtgagcagctcttccagccggatgtagttcttatcggttcgatttccatcaaatgaaagaacttctccctggatctcagacaagtttccaaggacgttccagacggctttatgggatgggtgctcctcacaagcaaacagctttcttttctcaagggcctccttcaagtcaatatatgtgatcagagtttgcacctcgatcactgctcttctcctggcttcccggatgcaggggtttttttcaagacttacctcatccaactgtccaattaaaccctgcaattctgttttggagctcaggtacaattcagaagggttttgtgcttggagaagttcattttttatttctctcattctcttgaggaccttttctatttttaaaatggaatgattctgtctcaggtcaaatgctttagttgtgtctgcttcctcttccaaatccagatatttcaataatttgttgatatcttctactacctccctccgataatttctgatttctgtccggccgcacacatctagagcatccaggtcagcgatcagccccgagagcacacaggataagtgcctgcaggtctcattgttgttcacacccatcagaagtgcaatcaggacccctcgggccttgttcacctcacacatcacgaagttgattttggcaacggaaggatgtgcatcctcggaaagcggcagggaaggctgctttttcatgcagtcttcgattatctcttgcaccgcacagattttggttaaagtgtgataccttgctttccgcaaggagatttttcctccagttttaacatgtgtcagcctcagaatgatatcttggatgccttcttcaaactcatcagttacgcagttgcctccattataaaatggcacaattttctctctcacgagggactgggcttcctcaaaaatgttctgtatttcaatccggtgtgggtggtttgcattctgctccaactctttgagaagacgttctgtctcctgtgctgcccgcttcctagcttgctgaatatctccttttccttcagtatctacagagtctatttcaaaaagctgttttgttagaatcctctccagtttcttgtaattcttgtcatctgacagaccactgaagccgataacttgctgttctacactttttacttccttttggatttcctgaagcctactaatagaaggatgttggtttcccatatccatacttttgttgtgttcagtttcacaagcactaaaagacgacaagaatgataacttactacagcacaaggcttctgcagaacactaatggtatattaagtcattctaaaattctcattttaaaaaggtatacttctgagcagtcatcccacctcagcctccccagtagctgggtctacagtcgtacaccactacgcccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtgaaacagtagctcttgtaaccttccgaacactaacagtaccccgccccgccacacagctatgcctagtttccagaaactctaagcaaaagaaagaaccagaacaaaaaccagtggctctcagacatccccaaggtccccgcttcttcgtttctctccatccctttgtgcacttcccctccccacccttttagctcctcacacatcttccctcacagaagtctccctgaagagattaaaaccccacaggtaaagaagagcgaccgggacagcgctgaagggcaccaccttgggctttcgaggcccaacacctcctcagcccccaacatgctccactctctcaaaaaaaaacaacccgcgaaaacgtggtaactatgaataattcattcactcgcctcccactgggagtccacaatggcctaatgcacgtttcaagctcttggtttctatcaaacggctcgctcaaggtgggtaaccaatggaaacgcataatctatccccggcggatgtcctggaggccacggagggaaggcggcccgagctgcttcctccccgcctcgcccttccctcttggccctttacccaaaagaagtctgaattggatgcggtcttggcgtcccgtggctgaggtggcgaggtggaagatcagccctttacggggtgcggcaccggagctgggcccccagctgcatgcctcgcacccctcccgactaggtctgagcggggcagccggtgaaggggccgctactggctgcagcagccgctccgggcgtcttggcccgggtgccagggcgcgcctgcaggacgtgacctcacaatgggcgcgcgaggggagctcggcccggccgggggaagccgggggaggaggggaaccgaggcccggccggagacaccagagaccaggcccggccagccccggtcgcttccgaccccaggggcggggacagcgccgagaccgactctgccctgcctgatccgacaggccgcacggggctgggcgctggcgaaggggtggcccagcggggagccccgcgcggaggtggtgccccactcgtccccccgagagagggaaaaggctacaagccgcgcttcgctcacctgtcccgcccgcgccatcgcgcgatgcgtcgccgacgcttccacgacttccgcagctccggcagtcgcccgggcccggcagccccgcccctggccgaacacccctaaacccggggacacctcctccggcgtccgcgcctagccgccggcagcgccacgcccaccgccagcggcgcagcgaggcagcctggagtgaccg

SEQ ID NO: 1291 - DNA, 5776 bp, Homo sapiens; identical to SEQ ID NO: 1289

SEQ ID NO: 1292 - DNA, 7903 bp, Homo sapiens
catcagcgggcgcggagccggaagtgttgtggccgccgccgccgcgcgtcgcggaggcacgtgtggagccccggcagcaggagcgtcgcaggtgagactccgcggggtacagggtggcagggcgcgggtgagggtgacccgggccgggcacggcgcgcagggcctgtccctccagcctcgcatgggcggcccccgccggcccggcctggccccttgttgcctctgcatcggctgggcggtgtttgcgtggacggccagctccgcgtccccagccccttactggggagccctgaatcctctgtcataccctgccacctagcccccgtgggggagactggggtgaggaatcaagcctggcttggaggtgacctcattgaccatttgcctctcccccgccggtggacacctcgcaaaggcgcttcctcatctcacatcttgggaatgggagtcaagctcctggagaagggtgatgggagggtcgggtcctcactccgggaatccttgggaccgaactccgccattgccaagcctcagtcttttcatctctgatttaggctcatagtccctgtctcttgtcctagaccaagaaaggcttcagaggccaggccagagtgcagcgctattgggctccctgtcaggcagtggcagagactgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggtgagttcctcaggctgcctcagtttaacgcagaaattgacacaaaggtggaggtcagagcctccagcctgcccttcctacagacacatgtggctcctcagtttctattttcacatctttccgggatgctgacagcagggagtgaaggtggaggcagagaagcccgttaggaggctggtgctgtaactggagtgagaggtggtgggaaatggaccaggaggagctggggaggactggtgctctagtgagggtcctgcttgccttggtggggcgtggccagcttgatgcttggcgctgtcctaggtactgaccgtcaacctctagtcctccgtgctgatggtgaagcagagagagttgccccttctggaaagaggccagggctaccccgaggagctcactgtaggtggggagccttccccatcctcatccatgatcagatcctcacctgctaccaatgaatgtgagcaccattgttgagtccagggcctgggctgtgggaacccctgcacatatacaggtgctggggccgcccagtgtggcgattgaagccaagattggccccaggcgctgatgcatctaggttgttggtggcgtgttcctcccgggcaggagagctagggtccaggttcacgaagagtgcctagcactgccatgctggctttctgagggctgcaggtcaccatgtccctccctggggtgtctgggtgggaggggtggagagcaggacttagccaactccatcagctgctgctcctgtgcatcctgtggtgggtgctggcctctccgcccctgccccactctcgcgagagagctcaatcaagcagcaccttctcctggcctcctcagatatgccaggtcccctcctaggaaccgtgaactagagagaccaggttcctgccctcgaggagggggacacagcctaggtgagcatctcagtgccgctggttgctgtgaagcctgtgagacagggctgcgtgtctgaggggtacccagagtggggactctccagctaggccaggcagggaagacctctctgaggaggggacatttgagttgaaaatgatgaggagggacctacgaagagccaagggacagctctgcaccaaggaggagccgtgccgaggccctgcagttggagcatgctgccgagtcaggctcagtgggggaggcagaggggctgggagtgaggttggaggggaagcgagctccaccccggaggctaacaagtctgacttgccccttagtgggaagggggcatggccaggctttgcagaggggcgaggcagcaggctgggggcacccaggggaggggctggacaggtggggagaggggctggcccctgaaaggaatgtgggaggtggcaggacgtgggacgggatagagggagtggaggcacctccatgggtctggcccaagcacttgcgatgctcagcgctatttgggttccaggcatgggtggcaagtgtgcagtggctgctctagcaggagtctccagtggaggggcctggggatgggagtggcatcaggtagatggcccctgaagctggagtgggaggagggatgcaagccttgaccctctccataagacaggaagtcaagcagaggggccatcttgagggaagctggggagggaagctgggggcaggtgcgctggggaggactggggccgtgtggctggtggccaggccctgcgtcctgagtccaaccaggccagggcagagccccagcccctgtgtggtgggggcaggtttgggcaggcttggtgggggtgggctgtctcaaggggaccaaggagcttctggggagaggtgggcatgaggaccggcagggtgggccactgttgacggggattgaggaagtgatgggccatgcatggaataagacagggctgagtgatgggatggcctccctgtcccccttgcacagatttccccggaggctccaggcagctgggctgctctcattccctatacctgcgctaggcaggatagggcagggttgccactggcctcgcctgtgcccacaacagacagcacggcatacacagcctgtcaaccccagctcacccctagacagggtgcccaacccagggctagcctggggctttaggcagccaggaccatacagccctggaatgacgcccacctgtagcttggggtcctcccaagccctgtgtgggtctccagggtgaggtgggggttgtttcctgggaggctgtgggtcccgagcagtcccaactgatgccttgcccatcccttcttgtcctgccaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggtgcatccggggttccgggagaggtacagcctgggtgggggtggggcaagggtgcaggactgagctcctgggatctcagaggggtccagagaccaagccacaccatggcagtggccaggccagggccccactttggcctgaggtgaggagtgggtcaggctggccaggggaggcagagctggggaggatggtccctggctgggccctgctcctggtctctggcctctcccaaccccctgatggaggaaggtggcagcgccacccaagtgcagggcaggcccggccggaggagtctggagtcccctccctgctgtttcccaaaacctctcctcccccaggctctggagcccagggagctggccccttttagggaagatgctgggtgcggaggcggggcagccctggggaaggtcgggcctcaagccagggaggtggctgggaggcccagggtttttcccttttctggagaaggagcagctcaggcagcaggggccccttccttcttcccagctgagagttgtattctgagagggttgaagggtggaggtgctgggcgccccaccccacctcaaagatgagccgaggcctggtgcgaacagcaaggctgtggccgggggtcccctgctggctccagcccagccctgactcctgggtcctggtctctgctgaggtgggtagctgtggggatctccacaccctgcctcctaggcttcctgctctggggacacttctgggcctggaccatagtcccagggaggctgaacccggcagagcctcccctggggcccccctgctgcctttgtgactccttcctccagcgtggctcggggaacccgcgcctgcctctgggacctgtccctttccctgcgagctcccccttctgggtccaaaggctcctggctcattcatgggcccggcatctcctgccggccacgggagcccgctggggaggatgcggcatgctcagcctctgtgccctgtctaggctgttgtcacacagcaggtgcctcctctaaccccgaacctcctggcggccccgtgttagggtacagctgaggagaccaaacctcagggacgtttgaggacacttgcctgggccacatacctctacccggccctggcttccccaggtcctccctgccaggacagggacccgggctgggttctcattcactgcaggccaggccaagtgaagcccgtggctgccctggtgggaggcggcagggaggggctgtcatgctcgggctctgcttcgagtaggcgcctcctgttcccgggagcagcgacagcctctaatttcctgtgacagcagcggcccccgcaccgccccacgctgccgtgctgtcagagctgctccgggcccagagctccagcagccctgtggaaggcaggagagcagtgcccgctgtgggccaagtgagacaatggcagcgcgggcttgacccggtgcctggcacatgggagggcctggcatggctaagctgggtgacatgaacagcggcgccaggccccatggggggctgtcagttgagggccaggcccctctgccctgcagtcccagctcttggagagcttgcagtctgtgttggggctgtcttaggctggcctcagaccctagggtgggagtccagggatgctagggccagacgggccaggctctgccacccctgccctctgaccctcgggtcctgtttcccacaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 1293 - DNA, 17926 bp, Homo sapiens
cgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggtgggtggccgtcgccccggccagcgcctccgacccgccccgccgccccggcccggccccgcgggcttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaacagtcgcctggcatgtggtgatgctgaaggggacactgagctacactgtgctggctgcgtgcttggggccgctaaggtgattgtcgggaggtgactcaaatgtgcagataaccagttgtgggaaataggtttatttgaggtggtttggaatggggagaggagaatttggtagaacttggcaggtgggtaacattgtccttggcttggtggccgtgtgccgatcggcatcatcgtcatatctgtaaacgtgttggtccattttcattccagctctgttcttagccaggggagtctgaatccagcccagtgcccgtctcccgaataccagctgcctgaccgggctggtttatcagtttgggcccatgagggttatccctttaaaatgctgcaaaaccccctggggagcatgtgcacacatgcacctttctccgagaggtggcctgcagctctcagattctcaaggctctgacgcagaaccagttgagaatcgtttctccagtctgtgcctcctcaggaacctgtggggcaggggaggcagaggcggcgtgtaaagcttcgtgcgacaccactttggatagaggtgctttgggggtgtgaaggaagcttcagatgatctctggggcttgtctgactctgccatcaaatatccgacactgacgcaaggcagtgggcttgggggtgggcggtccgggcgtgcagccatctgggcttgtcacaagcagctgagatcctgagttttatccttaaaatccttgccgctgtgcacccctcccacctcccatccgtggtgctggcagaagaatgaccgcagctccatgctggcgggttgacactttgatggatactctagattcagagccaggaaggagagagcacgtgcgcgtctgatcacgagcctggactcggatgaggagagatctgaagtgaggactgttgctagaggcgtctggagctgtgcagcggggagaacaggggaccctgagttctgcgagggtctcacaggccaggccggacagggcttttcttttgcagggaggagtggccaaggctagaaagaatcaagctggggaggtgggatgggccagtggagggtcaggacctccagcagatcagagagctgaggccagaatacaaaaattagctgggcgtggtgatgagtgcctgtaattccagctacttgggaggctgagacaggagaatcacttgaacccaggaagtggaggttgcagtgagctgagatcgtgcagctgcactccagcctgggcgaccaagcgagactccgtctcaaaataaataaataaataataaaaattcaaaaattagtcgggcgtggtggtgtgtgcctgtatcccagctcaggaggctgaggcaggagaatcacttgaaccgggaagaggaggttgcaatgagccaagattgtgccactgcacttcagcctgggtgacagagcaagactctgtctcaaaaaaaaaaaaaaaaaagtccaggtaagggaattgtgttccagttgatcatgaggagaaatggccagtgttttctgaggcagagaatgggaatttggagggccttgctgcaggtaagcaaggggggcatctgtgatctcctctggctcgtatggggagggtggttctcggtggaaggctttcccagcacactgcagggtggggggtttcataattgtttccaggatctcagcgcttgggtaaagctcacccctgtgaggtgccaggggctgccagagcctccacaggtgttctgggaaccagcagcctcatgagatactgccagggacaccagcgagctcctcaagggtccctgtggctggctaagagctttttcttttttgagacaaggtgttgctgtgtcacccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactgatagtaacgcacgtgtttctagtccctgagatgcaagtagattttgtctctcagaggtgaagttgatgtcctctctcacacaccccaccgcggggtccctgtgagaggagccagtttacaactcatatcttccttcctcacggcctgtatccatgtctgctctttggattctcctttgaactgggtttttagtcttattggttctctcattaactaatgaggtaaatctttgacgtgggttccttttctgtttgtaggagttacgctctaccagttaaacgtgattatctttcaataaaggtgcattgatacatgcatttaaattgttttttgattggcgagttcttggggggctgagaattagttgactgtgggagccccaccagccagtgggtgacgcttctcactgtagtgtgggagctcagagtgcgtggtggggcctgatgttttttgtcaccccagcctcaaagggagggcaggcctatgtccatgtccagcctgtgtcctgagacttggttctttttataactttttttgaacatccatttaaactccctaaactatactttcagattatatggaggcgcttttggtttcttgcgtgctgccaaaccccactctttggggtgggccgggtgctggttctgaggagctgccctgtgaccctcgaggggccgttcctgttgcattggagtgggggagcgggtctcgacctgcaggtctctaaggagctccatgctggtgtctgccgcactgtggaggagtgatgggcttcatgatttctgttttttgttttgtttgagacggagtctcactgtcacccaggctggagtgcagtggcgcgatctcggctcacttcagccttcacctcccgggttcaagccattctcctgcctcagcctcccgagtagctgggaccataggtacccgccaccacgcccagctaatttttaggttttattttgtagggacagggttgtgctatgttgctcaggctggtctgaaactcctgagctccagcagtccacccacctcagcctcccgaagtgctgggattacaggtgtggccaccacgcctgacctggtttcttctttcattgctcgcggccatcttgcttacccaccgggaagcctagtttatggcatctgccttgaccgcctccgagcatgtcatctggcagggtgggtgcaagtcagttgtggtttactggactagcaaggaggggacaagcgcccagggctctgactcctgtaggcagccaggagaagtgtgttccgaaatttcactgggagccgtctgcatgcacctgccctgatcctcgctccctcttggccccgcttcccttgagacagctccttctgtgtccatatagcttcccgccgagcctgtgattggccctgcaaggtggccacggaggcctcccatggaggtgagtgccaggcgccccagagaggcctgggccgaggctgcctctgtgacgccactgcacagggcacagagggctcctggagagcacttgggccccgccgtccatcctagggggcagtgtctgtcattagcgggtttatctgcttggcttgggcaagagggtcaggcagcagatgggtgttattaggggcactgcccaagctgaccttgcctcactctccctcttcatctctgtgtgtttgtcacagcctgcacctctggcctcgtggccctcactaaacacctttattatttatttattcattttcctcactaaacgtcttgaggcctgtttcattgggttgttcttggaggttttagtttccccagcgaatgtgctggtttgaaagtctgctccagcccacgctggtggtgacacatgtgtacctgggatgtgacgcagaggctggcattccagacaccgctggccacctacggtgaaaacggatgaatcacacttggtttctgggctttggtgtattctccctagctcctaaaatagctgttccactgagcatcagagctgcggggtccagttaaaggaggcgctggtgggagcctggtctggggcccggcttgctgtcctgcgcttcctttgcggggcgtgcttactggcggggtaggtatttggcagtagttttaccttatgtcttcatccattgctttatttcatattaaattgctctgttgataattttttaaatttctttcactaatataatcaataggaaattaccttatttaaaagcctatacatctaagctccttggttattttatagtaataaacttctggatcacttatatttttaagggggcaaatcctaggtgtggtctgtctctttttttttttttttttttttgagacagggtctcactctgcttcccaggctggagtgcaatggcatgaacatggctcactgcagcctcgacctcctgggctcaagctgtcctcccagctctgcctcccaagtagctgggactacaggtgtgcaccaccatgcctggctcattaaaaaaaatgttcaggccgggcacggtggctcacgcctgtaatcccagcactttgggaggccgatgcaggcagatcacaaggtcaggagatcgagatcatcctggctaacacagtgaaaccccgtctctactaaaaatacaaaaaattagctgggcgtggtggcgggcacctgtagttccagctacttgggaggctgaggcgggagaatgacgtgaacccgggaggcggagcttgcagtgagccgagattgtgccactgcactccagcctgggcgacagactccgtctcaaaaaaaaaaaaatgttcgtagagacagggtcttgctgtgttgcccaggctagtcttaaactcttgggctcaagtgatcctcctgcctcagcctcccaaagtgctgggattacaggcgtgagccactgctccagcagtgtggtgttatatttagaaattggcctttcagcttgcccaaacacaaactgcacagtaaatgtgaaaagcagtcctctttcaccaccgtctgctgagaatattgagagccctctcccctcctgtcgggcgctgtgggccagggtcaccatggagagaccatcaatagttactctcactggaacctggtgataacgtggcctcgtgtttgcttaagctcagagttaaaacccccgtgaagctttctctagcagattctagtggattctgtggctagtggatgtctggggtcagggaaggggccaccacacagaggcagggactgtgccaccgcacagcaggcagaacattccagaaccgacaggcccatttgagggcaatggcagggctgggctgaagcacaatcagggcggggaacagccagccaacgcccacagcccgtgggcagggagcccctggcagagctgccagctggactttttagatgcttccagaaggctggggtgggccaggcctggtttccaagtccaggaagcagcttaaaagcaaagggaaacaaaaaaaggctggtcgtgggatctcacaaagctcaggacctgcctgcctgagttggggcagtggcgacatggaactcggcagggatgaggccctcgtgtgggtcgcgacgggccagtccttgctgcagaatggcgtctgaagggcccctgatgtgcgccacaaccgggacctctgtcctcctacagtgagggtacacgtggctgtgggccccataggactccttccagaagcatctgcagagtcccaggaccaccagactctgttttgccaactaagcacagtgggcacttggcacctgatgtggactgtctccgagccccctgtggaggggctgcaggcttcctgtgctgcctgtgtgggtcccgcaggctggagggaggcccctgcctttgcagattgcagggtggcagggacacgctgagggtggcggggacatggtgagggtggcggctgtgatggcaccgcatcagagcagctcctccacaccagcgtcttctggggctcagagaaggggttggacttcccagagaaggggtgcagggcagggaagagtccccatgcctatgagggagaggatcagggtggggtgatggaggatccgtggctgggcccccagaccacagggaggctgtgcagccatgtcagaggcgctgggggattgggcggccgcgcggtccccaccccagctcagacccaggggcctgtgttccagaaggtgctcggccccggtgaccccacaggccttgcctgcctccttgtggaatcagccccagcagtgttcgccggcccagggttgggctggaacggtgccatgcgtgtgggagcagctttcccacggaggggccgagccctgtcagctgcttgtcggtgccagcacagcccgtctgtccttggtggagctctgaggcggctctcgcgttagataagacgtctgagctcttgtgtggcttggtaatgctgtggccacctccagtctgcctccttttcgagacttcaggccctcagtttatgctcgccaggtaattcctggtctcgtttgggggccccctccttcccccagaagggaaaagggggctcttcgtggagcgaaggtcttctcttacatctcttttgaggattattgtgcttagaacatggatgattcttggtcaatattcagccgagcccttaatcatcagaagccaaaagaccctccatctctcccaagaggacccctttgactcccaccgttccgtcgctggttcattgaacccacacctgtttctggttcaccacccgccaccgaggtctctgacagcgaggaccaaagcggggtgtgcttgtcacaccttgtttcatccttaccaaggaccccagagcacgagggtcttgttctcatgaagctgagggaggcgaggcgtcctgggtcccgcagcccccaatgcgctgctgaagggcctgctggggagcgggtgggcagcaccgagggccagctttgaaaaaggctgtaccggcttaccaaatccggggaccattttcgtggcaaaagtgtccctcactctgttaaaagaatgcatggtgacacagatttccttcagagccaggtctgaatgtcttccccttggactgaagtccctgctgttagagcgggggagccggcggcgatggcggcgtcctcgtgctgcgctcgtgccggcgtcagggtccccctgccatctggagtgagcaggaggcggccaggccaggccttcccagctgaggtttgggagttccgtgcctttggtgctgagggtgagcgtgttcacggtgacttcgtcccttggtcatgaggaggttcgagctaggaaccccctgcaagtggtcaacgcatccggcttgctgttctaagtggaggcggcaggcacagctgggacccacgcccctcagaagcaggctctgtggtggtcggagcaggcacctcaccaggccacgctccatttggggctgctgagaagctggctgtggccagtcctgaggtctctgcagccctcgggagcttggaggcccggctggtttttctaaggagttggccgggtggccatggctgcccacagtggggtgtgaccttgggcttgtggcctcctcagtgagggcctcctggcaggggctgagagcccagcgtcagtggggggcttcagcatagaccaccacatgtgtgtctctgggtgcttggtaaatgcaccctgtgcttcggtgacaagtttttttgtctagtcaagtgaagcagtggaaatgcagggagcatcttaaatctgttttatttctaactgatttcaattccacctttacccttaggccgaccaagcatctgaggtgccgggacagtaccaccttgccatggggcttcaggcctgctgtgaccccttggggaaagtgagccccatggccacctgcccagttcccaggtcttgtgctgtcagaattcctggtgggccctgagcccagtcaccttcctgtttctgtctacctttgtacattctgtgtgcatagaacactcttggccaacaaagtccagccttgtgagccctggcttgtgagtcttacagcttctctgtgcctgggtcctccagctgaggaagcatcttcagggcgtccccaggcctggcgcccgcccccgtggcacacaccggcctgcgtgtgcttcagctgcttccaggggttccctcacaggcgggggtcagggcacgcacgccaggactccaagtaaactagaataataagctttatgtctcagatacctgggcttttgccggctggcgcgcagccccagaatcagcacctccccatgctcgcctcgtttgtgaagtgggtgctagcacagccttccctggtttaggggtttaggttggctcttgctgtggatttcctagtcccttcgtggcgttgctctttggttccagtaacaggaccagggctaaaaaggcgttgttaaggtgaactgctgttgggtccagtgtggagggacctgaagtgccaggatgcatgctctgctgcgagacagtcaaaccccaagcccacctcaggccccatggttacgctgggtgcatctcccgcaggcctgggagcagcctgcaccccaccgcattggctctggagcctgggcacaggcggccagtccaccgtcctgcgtcacaaccctgcctgcctcaggctgcttgggtgcgtggggaggtggcagggcccagctttctcagcagcccgtggtcgtgccccagcgacgtggtgagtgaccaagctgcgttttaacgctttgtcgtgtctttcctagtgtcggagatgtatgcagtgtgacgccaagtttgactttctcaccagaaaggtgagctgaggccgctgagtgggggtggtgggaagaggggaggggccccaacaggacagctgccgctgccccttctggcaggggacggatgtcatcttatggctcgttttttttttttttgagacggagtttcgctcttgtcgcccaggctggagtgcagtggctccatctcggctcactgcaacctctgcctctcaggttcaagtgattctcctgcctcagcctcctgagtagctgggattacaggggcttgccaccacgcctggctaatatttatatttttagtagagatggggtttcaccatgttggccaggctggtctcgaactcctgacctcaaatgatcctcccacctcggcctcccaaagtgctgggattacaagtgtgagccaccacacccagccgttatggctcattttgagtgtcagccatgccctgtttccgtggaaagtgactgtgctgattctgccggacgctatggggtgggggtgcagcttgcgaggcctgtgcacccacctgccccccgccccctctgccccctccgccccgtccccgtgccgctttgccctcgtgaagtgtcttgcccctaatgtgtgcccagctcatggcgccccgaggcgcgagggcgtcctaagcagtgggacttgggtagttgaaagaaagctgaaaaacagccattttgatccatgattttgaaaaaagggcctcatttcccaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggtaaggacgggtgtcctgcacagtcccgcgcgctccgccagccggctcctcgtgtctgtggcgatgctgtgggctgtgcacggggcgttctgcttctctgacgttctctcgccctccctcccttccccgttttcttctggattcgtttagaagcggttatagagccttcccttcttttcagaggcggaatgtcgtctaaaatgttggtgctgactccgctgggcacgtccatcaggtgggaggggaggccctgggcccaggcagcaccttcctccttcccccgggtggaacccggcgccggcgctcgggcgtttgcaaccactgtggctcctcggaggggccggagacctttgcccaatagcacgatgcagacccggttttgagccatctctggggacctggtgtgggagaagggcattctccaggggcatagggtgtgcctccctggaatctgaacaacgagcagcgccttctccccactgtccgtccacctctggccactgccgtcccagcctcctgtcccctgcctgcccgccgtggggtctgggaccacctgccttcctgcccacagctccatcctgtgtgaaacgggcatggtccctggctggacggtgggctttgttgtgcctcctttctgctgtcttggtcctgtcctgccagctcttaggacgtgtgagcagagtggtttattgttctttgatctggaccttggtgatgaattccctgcatcgtttgaaggatgtaaaagaatttctaggagctttgtaagcaagcagaacctgtctagagcagcgcctttgggtttacctcttaaacccttgatccatgactgcctttttgctcagctgaaggggtccttagaacaaagctgtggtttgtttcttgctgtttttactctgtcctctgtgcgtgcgtctcctactggtactcgtgggaagggttaggtggaaaagaagcaggccctgttctcacgtttgcttttgtgttcccaaggagccaccttcctcgtcacgtttggaaactcagagaaacctgaaactatgacttgtcgtctttccaataaccagaggtaagagccggatcctgcttggcacggggcagcattgtcacagaccgggagcctcggtggcactgagcctgagaatgacccgatttggacacttttatttgatgtagatacttgtttctggatggagacagccactatgaaatcgaaattgtacacatttccaccgtgcagatcctcacagaaggcttccctcctggaggtaaatgccagcacgtcctttcctaagccaggagggtttggtgccatgcgtgggtgacaagaggagcatgcacttttgggatcaggcagctgccctgaggagtggggtctgctgggtttccaggacaatctgcctttcctctttcgcggggcgtgtatttactcagtggctttagaactcgccaggtgagtggagacttaaactgtaagacaacaaagggacatttgcctcagcatgtcataatgatttcctctgctctaaatgctctaacgtatcattcggtttattgttggattcaaaccaaggataaagccccaaatgcaataactgagatccccaaaaaggtctgaatggtggctcatcgggagccagcacttcagccctcctcctgcaggcgtctgtgcagactaaacccctggtgcatttcctggtgagctttggcccatcctgggcctctccactaaactctgctgacggggagctcgcatcccgttatctgcaaactgtgctgacagatgcgtgtgccgtaacccatgttgctttccttccgttctctcaccggctcttggttgctccttctcgccactgcctgcccaccttcttgccatagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaagataccgcagcagatgtactttctcagttctgtctcagcgggagggttacccagcaattgacagctctctgtcagtacctgccagccctgaacaggctgaggccagggggcgtgggggctcacctgcccttgggagcctctgccaacactgcccttccccccgaggcctgctgctccccagctcagtgtggcctcctgggacccctgactctcctggcacttctgtcagcctcctggatggtgaggtgagatgcccaggccagtgttctgtcctgagctcagggatgtgtgtggagccgggatggcatcaagctggttgccttgagcaggctgcaaggtatagatgcccaggtgcaaagggtagggtctggagaagcgggggtcaccccaggcacccctctctgcctgcctcctcctggggagcctgaggctcagatgaaggccagtgtttaggggcatcagatgaaggccagtgcctcaggaggccagggcaacacagcctcccggactgctctcccgggcagaccctccccagggcttctggcactgtgtcccccttgtggtggcttggggggtgcagtgagccccgctctgcccagtctcagtagagcccttcagaccccagcaccctgtcttccggtgggggtggggacaataggaacagtcccctgacctgaaggcagccaaggggccgcctgccagcctgggccctgtagggcaggccacacactcattctttcaaggccagatagtaaacctttgccagccacgtgtgctgtggtgaaggcggaggcggctgcagaagacagggtgacagacggccatggctatgatccagtggtgctttatcaggcaaatgcaggcggtaggcagagccatggtcgccctgctctagagcctaggcaggacgttacactgacaggcaaggttccccagtgttgggggtgggggtgcgtgccctaaccacagaaccgggcttatgaaagtgtggttctagaggcccggcatggtggcccacgcctgtaaccccagcactttgggagactgaggcgggcagatcacctgaggtcaggagttcgagaccagcctgggcaacatggtgaaaccctgtctgtactaaaaatacaaaaattagctgggtgtggtggtgggtgcctgtagtcccagctactcgggaggctgaggcaggagaatcgcttgaacccaggaggcggaggttgcagtgagctgagatggcaccactgcactccagcctgggcaacagagactcaaaaaataattaaaataaagccaggcacggtggctcatgcctataatcctagcactttgggaggttaaggcgggcagatcacctgaggttgggagttcgaaaccagcctgaccatcatggagaaaccccgtctctactaacaatacaaaaaaaaaaaaaaatagctgggcgtagaggtacacgcctgtaatcccagctactcaggaggctgaggcaggagaatcacttgaacccgggaggcggagggtgcagagccgagatcgcaccactgctctctagcctgggcaacaagagcaaagactccgtctcggaaaaaaaaaatgtggttccggggcctcccaggggacagcgtgtcataggttgctcaggcctccaagcacggtcggtgggcctccgactgcagccttggtgcccactccaccaaccggcagaagagccggccctgagtgctgatggggggatgtgtgtctgatggaggggtctcctgagaggtcagtgattgcctacgatggggcttccctcccaagtcatcaagttcatgggaggctgcatcccatgggtctctttcaacaccagccctgactgaagagctgctctcttcagcagtgtattgttggagcgagtgctggaattgagtcattgtcactggaacagctggtcaccgcccaaagacggggagcctgggtcccagagaccagtccccaacatgggtgctgggtctggggagatggcccgtgaccaggctggggtggcatttccctgacactgggcctttgtagtgacaatcccctctgtgctgacgccgcttctcaacggtgggatggctgaggcctctgactcctgggtgaggccagctgtgtccctgaccatctgcttggcctgtcagtggccagggcactctcgaggtggcctccactcttcccccagccctgggtgcaggtgggcacctctgcaggagccagtcttgtctggaggttctctgaaggcaggaacccccacaggccccagggcatagcagcgcctcaattagccgagagcaaggcctctcgtggtgatgtggctcttgttgtttgtcccgggccctggggcacccggctgagtgtcttggtccctctcccaccccacctgtgagcttggggtctcccctcagaggcctgaggagatggtgttccctgggtgctcctgagcaccagccctcactgccaggctactcttggagcagcacaaggttaggatgtgctggccaccgccttggggctggtggccgcctgggcactcagggcctcctttgggccgtcttacctcgtctctctcctccaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggtacctgagcccaggccagggaggctgggccctttggcttagacaaaagcttgcctttcccagaggaagctctgtgtcctgccatttgccccctatccccacaacctgttccccctcagctggggtgcccacgccatctcccctgaaatgcacacaggcttggctccaccaggcacaggaccaagcaggcctcactgtgttgatcttgtctgatctgcaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 1294 - DNA, 17871 bp, Homo sapiens
ctgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcatactttgatcatctccttatttcctccacacacaaggacccctgcactgccaatggccccaggagagggcagagtcagccacagggaccccacctcacaggcttcaacactgctgatgcctgtcatcccagcaccgtgggaggccaaggcggccaaggtcgcctgagcccaggagttcaagaccagcctgggcaacacagcaagacctactctctaccgaaaaaaaaaaaaaaaaagaaaaatagctggccagtgtagtggcgcttgcggtcccagctacttgagagcctgggaggtcgaggttgtgcctagctgtgaagacgccactgcactccaccccggatgacagagccagactgtctcaaaaaaaacaataaaaattcacgccttgtaataaggaattaaaggcaggatgaacaaacattttcttcttttttttgtgtgctttctgagatggagtctttttctgtagcccaggctggagtgcagtaatgtgatctcggctcactgcaacctccgcctcccgggtcctggttcaaacaattctcctgcctcagcctcccaagcagctgggattacaggcacgtgccaccacacccagctaatttttgtatttttagtagagacggggtttcaccatgttggccaggctggtcttgaactcctgacctcgtgatccgcccgcctcggcctcccaaagtgctcggattacaggcgtgagccaccgcgcccggcctaaaggattttctttccaaatcaaagtattaaaataactgttcagacctctcccacttcgatgcgaagccagcgcggtcccaggcggacgagcgaaggcatcgaaggccgggggcgcagccgcgggcccacctcggcctcccctgagcggacgcctccccgcgcgcaccgggggccccggagaccgccttccccgctccgaacgcacgcggcccggccccggcgaggtgcctgaacgctacccgagctgcggcggggctcccggggtgagtgctgcagccccaggcccgcctgctcccacaggctcgggcaatggagacccgcggccgcccccgccccttgaccctgcctcacccctcacgcccgctgccgcccacgacctccgaccccgctgccgcccggctcgcagcccggctcgcagcccggctcggcgggcctcacctcccgcgggttccgcactcctcttcccgccgtcctgctcctctcggccttctcctccaatag

SEQ ID NO: 1295 - DNA, 57045 bp, Homo sapiens
cggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctccaactaaacttgaagcagcctccgtcctggaatgctttttccatgtaaaattgggtgtacccttttccttaagaaaattaaaataaagcgtaaaagtagtgaaattaatgcgtgatggagtggatggttttataacttaacatttgtaggtcatttctaggtatatttgtattagaattgttgctgcctgttactgttttattatttaaatgaattaagaatttacatattaagcgtttgaaaaggaatacttacaaaaatgatgttttttaaaaatgtgagaacaaaaaatttgagatatactatttcaggtgttctgtaaaagggcagttagagctttgattctttgcattagttaaatcccaaggcctttttttttggtacggcatgactaagccattgatcagaatcagctcggaatacattgcactagtttagtgaaagacactttagaaaactggaagaacctcctgaagttatattacagacatggccttgcttctttcagggattgtcagcaagcctgttatggtgagaaatttgacctattgctctgtttcctaaatatttgtaggaatacaatgatactaagtatgaagtatatttcaacttgtatggaattctgtgtgggagggtaggcactctaaagagccagtgtctctccaagtcatcaaagaatgcagcatcatgttgcagttgagcctggcagccctgtctggcactgagtgctgtggaggacccaggtggtaacctctaaccctactgcagccttggcattgtcttagagaaaagcatccagacatgcacaggactctggacagcgtttatctccagcaaggggggagggaatgacactggggagaggcacacagtatcttcagtatttcatagcaaataactgcagtcgtttaaacttacacattttttttttttttgagatggagtctcgctctgtcgcccgggctggagtgtagtggcgcgatctcggctcactgcaagctccgcctcccgggttcacgccattctcctgcctcaacctactgagtagctgggaccacaggcgcccgccaccacgcccggttaattttttgtatttttagtagagatggggtttcaacatgttagccaggttggtcttgatctcctgacctcgtgatccgcccacctcggcctcccaaagtgctgggattacaggcgtgagccaccgcacctggcccaaatttatacatttttaaaatttatacattcttaggcatgtttctcaatgttggaaaaaagtcaatgtgtaactttctgtatagggccataaattatcttaaaacatacttgtataaaaagaaacctaggatagaaaaatcaaaagttgagtgaaatgtatgattagtatcacctgaaaacattctttgtagataagtggaatgttagaaaccagtattttatttttatttatttagagatgagtctcactgtgtggctcaggctagagtgcagtggtgtgatccccgctcactgcaacctccgcctcccaggttccagtgattctcctgcctcagcctccctagtagctgggattacaggtgcccactaccacaccaggctgattttttgtatttttagtagagacggggcttcaccatgttggccaggctggtctcaaactgctgacctcaggcgatccacccgcctcagcctcccaaagtgctagggttacaggtgtgagccattgcacctgggctgaaaccagtattttatgtagcaaagaaatgatcagtaatatactcaagacgagagtatttgggaagatttaagtgtcaaatttcagggcatagaataaaagtgacaagcacattaagattgcaaatactggtcttaaatgtctgttgggaaccaactgaatggcaggtactgtgctgagtagtcagcgataccttgataaaagagccactgttggccgggcgtggtcatgcctgtaatcttaactctttgggaggctgaggctgcagatcgcccctagctctttgggaggccgaggcaggtggatcacctgaggtcaggagtttaagaccagcctggccaacatggtgaaaccccgtccctaccaaaaatacaaaaattagccaggtgtggtggtgcacacctgtaattccagctactcatgaggctgaggaaggagaatcgcttgaaccgggaagtggaggttgtagtgagccgagatcacgtcactgcagtccagccagactccgtctcaaaacaaacaaaaagagccgctgtcagccgtgcagtggctcactcctgtaatcccagcactttgggaggccaagatggaccgatcacctgaggtcaggagtttgagacccgcctggacaacatggtgaaaccctgtctctactaaaaatacaaaaaaaaccaaaaccgggtgtggtggcgggtgcctctaatcgcagctactcagaaggctgaggctggagaatcgcttgaactggggaggcagaggttgcagtgagccgagatcacgccattgcactccagcctgggcaacaagagcaaaactctgcctcaaaaaaaataaaaccaaaaaacaaaaaaactctgtcctctaggagctcacaggctggcatgggcaggtaccacagaccaggttaaaggctgtggagtgcactgaggaggcgattcttcacaaaagaaaagtaccaatcagccagtgtcagggggtcaggggtgggattgggattggggttcctgcttggaggaaataaatcctgaggttgtgctgctgtaaaggggcatgttgggaaggggacatgggagtgagtgtggaaagacgaggttaggaaaggccttgaatgacttcttagaagtctgctttcattctgaggtttacaaaggagggttggaagattttttttttttttgagatggagtcttgctctgtcacccaggctggaacgcagtggcacgacctctgctcactgcagcctctacctcccaggttcaagtgattctcctgcctcagcctcccgagtagctgggactacaggtgcgtgccaccacatccggctaattttttgtatttttagtagagtcggggtttcaccacgttagccaggatggtctccatctcctgacctcgtgatccgcccgccttggcctctcaaagtgctgggattacaggcgtgagccaccgcgcctggccggagggttggaagattctgaggagccagttgccactttagaaagagcataggcagtggtggggcaggtgctgtgaactgggatgaggttaattaggaagccattaaccccaactcggcaagcctcaggattagggcagtgacagaaggaacagagaagctaggtgggggcaggggctgggctgtaagggttatagtggagctgatttggggctgactggattggggtaaatgaggagctgcagggaggactccccagaatgatcctgtgaaaacctgagtcactcctctgttaaagcttttgtcagtgtcctctgagcaccccaccctgtctcttttcatcttcctgctctggccctactcaagcacttccaggtgcatctggagttctgaaccaaacccattcttgtagtgattagcatttcttcacttccccacatactccttagcctctgccctgatttttctccttagcacacctcactatcttaaatgctgtattattattattttttttttattattactttttgagacggagtctcgctctgtcacccaggatggagtgcagtggcatgatctcagctcactgcatcctctgcctcccgggttcaagccattctcctgcctcagcctcccaagtagttgggactacaggcatgtgccaccacacctagctaatttttgtatttttagtagagacaggatttcaccatgttggccaggctggtctcgaactcttgaccttaagtgatccacctgcctcagcctcccaaagtgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaatctgaagtgcttgtggggcagccaagtggactagtgggcagttagagatacatctttggagctcaagacagaggctgaggctggaggtaaagattccagagactgcatcatatcgttgagccagtcgggtgtgatgtccatctggtagagatggggagtgggtctaagaggagagggtcctgggaaaccaagagaagaggagggaggagatcagtagcaaattggctaagaagtcagtgatgggttggactgagaagtctctatggattttgcttctaggaggttactaatgacctttaacttttttttttttaaatatagtttatgtagagacgggggtctcactgtgtttcccaggctggtctcgaattcctgggctcaagccatctgcctgccgtggcctcccaaagtgtcgggattacaggtttgagccactgcacccggcctgttgcctgtttcctgagaatattacctcttaaggatggaggctatttcgagatgatcttcattcgttctcccaaggcatcctttgtggcgttgtactctgtagcctcctagttagtatactcatggatcagaaatgaattatgatttttttttagttttaactaatttttggaggcagatgaaagcagtttgcatatatgctttttgaatttgaaaagtgctatctgaacttaaagcaacggatatggagcaaacatgttaagctgagttacgtgcatacgtgaactgagttacttccttggttctaaaatatctgttaccttcatttaaaccatagattgttccctgacttcagttgcataacataaatttatgttcaggcttctctgaagttcactatgctgctactaaaactgatcagagtgatgtttgcactgttccagagaaaataggtactgtaaaccctgcggatgtcatatgtgtctgtagtttcagttactccgaaggctgaggtgggagaatcagttgagcccaggagttcaaactagcttgggcaatatagtgagaccttgtttcttaaaaaaataaaaggctgtgcttggtggctaatgtctgtaatcccagcactttgggaggctgaggagggcggatcacctgaggtcaggagtttgagaccagcctggccaacatgggtgaaaccttgtctctactaaaaatataaaattagccgcgtgtggtagtatgcttctgtagtcccgggtatttgggaagctgaggtaggagaatcacttgaacccgggaggcggaggttgcagtgagccagatcgagccacggcactccagcctgggcgacagagtgagactcccatctcaaaaagaaaaaaaaaaagtaaaataggtactgttactgagattctactgttgaggaatttgagggtgagagaggggaagtttcagaaaccaaagttacacagctgtgaagtcaagattctaactcagtttttttgcttcgcggtataagctttgaatcaccttgcagtacttaaagctgcagcttcaagtgaatcatgataatgctgtttaatcctatcattactttttcttggggaaacctcgcgccacttcaatttttttcaaagatgtaccattttaaccatttaaaagttcacaattcagtagtgttaaggatatgcacatcgttgttccacatttctggaactctttcatctggcagcgctgagactgtagcccccaaatactgatatctcctcctccctcgccctcccccggtaaccatcttttctactttgtttctatgattttgactactttcaatactttattttttattttttttgagatggagtttcactcttgttgcccaggctggagtgcagtggcacgatctcagctcactgcaacctctgcctcccgagttcaaacaattctcctgctttaatttcctgagtatctgggattacagtcatgggccaccatgccgggctaattttgtatttttagtagagatgggtttctccatgttggtcaggctggtcttgaactcctgacctcaggtgatcaccccccatcggcctcccaaagtgttgggattacaggcgtgagccaccgtgcctggccttgcctgtctttttcatctgagccattctagcggggtatagtggcatcttgttagttttaatgtgcatttcactgatgactcataatggtgagcgcttacatgcttgtcggtctttgtatgcctggatttgtaaagtgtctgttcaagacttttgcccatttaaaaaattggattgtttgtatttttaagttccttacatatttatttatttatttatttttgagatggagtctcctctgttgcccaggcttgagtgcagtggcgcgatctcggctcactgcaagctctgcctcccgggttcacgccattcccctgcctcagcctctggagtagctgggactacaggcgcctgccaccacgcccagctaatttttttttttgttgtatttttattagatatgggtttcaccatgttagccaggatggtctcgatctcctgacctcgtgatccgcccgtcttggcctcccaaagtgctggtattaacaggcgtgagccaccacgcccagcagttccttacatgttttttttttttcagatggagtcttgctcttgctctattgcccaggctgacgtattttttatacaagccgtttgccagatatatatgtgtcgcaaatattttttcctaatctatggcttaactttattttttggtagtgccttttaataaatcaatacttttaatttttcttaaccatgctctggcaagttttattaaagaaattttcggctgggcgcggtggctcacacctataatcccagcactttcggaggccgaggcgggtggatcatgaagtcaggagtttgagactaccctggccagtatggtgaaaccccgtctctactaaaattacaaaaattcgccaggcgtggtggtgtgcacctgtagtcccagctacttgggaggctgaggcagaagaatcgcttgatcccgggaggcagaggttgcagtgagtcgagattgcgacactgcattccagcctgggcaacagagtgagactctgtttcaaaaaaaaaaaagaaattttcgcagggtttatttttatcttttattttttgttgttgcctaagcaacatccgctttccttaattctgaaagcatatctataaataagtcacccaaaggccaaatagatgcatttgttttgtctggttgttaatgttttctttttaaaaaaatatttatgtatttatttaatttttgagacaggatcttgctctgttgcctaggttggagtgcagtgtcacagtcgtggctcagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctcttttagaaaattgaaatgtaagtcacatcacatcaaatgccccattttaaagcgtgcagtgcagtgatttttaatgtattctctgttttgtgcaactaccatctatctaattccacacattccttttccctttttagtgcttggtgttttttttttttcttaactttcttcatcactgtaagctttccccacctggctgaatttcacatgataaaaccaggggaggtaaagtgaccaaagatgatgccctttgcttctctggcctttgctttcatttcattaatttttttttttttttttttttttgagtcagagtctcgctctgtcacccaggctggagtctgggtgtatatgtatgaacacagtggggtgtgtgggtgtgtgtgaacatagtggtgtgtatgtatgaacacagtgggggtgtgtgtgcgtgagcacagtggtgtgtgtatgtatgaacataggggtgtgtgtgagcacagtggtgcatatgtatgaacatagggtgtatgtgtgtgagcacaagggtgtgtgtgtgtgtgtgcgtgcatgcagagtggtagggttcctgaagcagagggacacttggggcaaagagaccttggattgtgttcttcttgttggtagaataagcttaaatcacttcatgtatcccagtttcctcagctgtaaatgggaattataatgataggtcatcaaactacctgcagactttttttgttgttatttcgataaaatattacacatttgaaaatgctcccaaaactaacatattggacagatgcgaattcttctttccttttttttgagatggagtcttgctctgttgtccaggctggagtacagtggcatgatcttggctcattgcagcctcagcctcccaagtagctggaactacaggcatgtgccaccacgcctagctaatttttatatttttagtagagatggggtttcaccatgttggccaggctggtcttgaactcctgacctcaagtgatccgcctgcctcagcctcccaaagtgttgggattacaggtgtgagccaccacgcctggctctttcttgtcttttacttatttatttttttgtgacagggtttcgctgtgtcacctaggctggagtatagtggtacagccaaagcttactgtagccttgagctcccaggctcaaacaatcctcccaccttagcctcctgagtagctgggaccacaggcgtgtgccaccacacccaactaatttttatttttgtagagacagggtctcactgtattccccaggctggtcttgaactcctgggctcaagcagtgctcctgtcttggcctcccaaagtgctgggattactggtatgagccaccacacccggcccagatgtgaattctttatttttattttattatttttgagacagggtctcaactctgtcacccaggctagagcacaatggtgcaatcatgtttcactgcagccttgatttcctggactccagtgatacacctcagcctcctgagtagctgggaccacaggtgcatgtcaccacacccagctaattttggtatttttttttaggatggggttttgccatgtttccctgtctggctttgaaatcctgagctcaagagatccacccgccttggcctcccaaagtgctgggattacaggcgtgagccactgagtcaggctgtgaattctttcttttattttctttatttttgagacagagtttcgctctgttgtggagtgcagtggcacgatcttggctcactgcaaactccactttccaggttcatgcgattctactgcctcaccctcccgagtagctgggattacaggtgtgcaccactatgcctggctaattttgtatttttaatagagacagggtttcaccatgttgaccaggctggtctcgatctcctgacttcaggtgatcgacccaccttggcctcccaaaattctgggattacaggcatgagccactgcccctggcctgtgaattcttttttttttgagacagagtctcgcgctgtcgcccaggctggagtgcagtggcgcgatctctgctcactgcaagcgtcacctcccgggttcacgccattctcctgcctcagcctcctgagtagctgggaccacaggcgcccgccaccacgcctggctaattttttgtatttttggtagagatggggtttcaccgtgttaaccaggatggtctcgatctcctgaccttgtgatctgcccgcctcggcctcccaaagtgctgggattacaggcgtgagccaccgcgcccggccctgtgaattcttaatatacatattgtatgtatacttttttggttttgtttttatcaagttatatatgtattttgtatttatgtgtagatttgaaaataaacttttaattttagaatagttacagatttacagaaaagttgcaaagatagtacagagagttcccacatactttgcatccaatttcccctaatgttaatatcctacattactgtgatacatttgtgacaaccaaggaaccaacattggtaccttactattattattactattattttttttttcttttgagacaaagttttgctaggtcacccaggctggagtgcagtggctccatggctcactgcaacctctgccttctgggttccagcaattctcctgcctcagcctccctagtagctggaattacaggcatgcgctactatgcctggctaatttttgtacttttagtagagatggggttttgccatgttggccatgctggtctcgaactcctgcccttaagtgatccacctgcctcggcctcccagtgttgggatcacaggtgtgagtcactgtgcccagcctggtacattattattaactgaactccactttatttggtatcactggtttttcccttgtccttgttgtacctcaggatcccatccaagataccatatcacatttagtcatcatgcctcctgctctgtggctgttttcttagactttccttgcattagaggactgtcttagcttgcgaggctgtaacaaagtaccacaggctagtgactcacgaacaacacaagccacagtcctggaggctggaagtctgggatcagggtgccagcatggtcagattctggtgcagaccctctttctggttgcatgctaccgacttctagatgtattctcacatggtgaaaagagtgtgagagagttccctttttaaaaaaaatttaataataattatttttttgagacagagtctgtctctgttgcccaagctggagtgcagtggcacaatcttggctcactgcagcctccgcctcctgggtgcacttcatcctcccacctccacctcagcctcccaggctcaattcatcctcccaagtagctgggactacaggtgcacactacaacacccagataatttttgtattttttgtagagatggggttttaccatgttgcccagactggtcttgaacacctgagctcaagctatctgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtctcgaactcctgatttcaggtgattcacccacctcggcctcccagagtgctgggattacaggcatgagccactgctcagcccctgggttcccttttttaaaggcactaatcccaccgtgaggggtcccctcatggcctaatcacctcccaaaggccccacctcctaaaagcattactctaggcattagaattttaacatgtgaattggggtggggggcacacattgattccattgcaataaccttgatagttttgagacatatgggcaaggtattttgtacaatgtccttaaatttgggtttgtcttgatatttttcccatggttaagtcagggttatgagtttttaggagaaagactactggctcccagttttggattctgattccattgtaccaaaacaaatcagaactctttggagtaatgggtgattctagggctggggcagggaaaatataagatgagcctgaagcttcttctagtgtttgaatgtaaggatatgctaaaaaacaaagggatgggaacatgaagaagggacacaggaaccaactgaaagagctcccattgacaaaagctggaacaacttgaacaataaaataaataatgtagttttttggttttttggttttttttttttttttgagacggagtctcactctgttgcccaggctggagtgcagtggcgtgatctcggctcactgcaacctccacctcccaggttcaaggcaattctcctgtctcagcctcctgagttgctgggacaacaggcgcacaccaccacgcccggctaatttttttgtatttttagtagagacggggtttcaccattttggtcaggttggtctccaactcctgacctcaggtaatccacccaccatggcctcccaaagtgttgggattacaggcatgagcctccatgcccagccaagaatgtatttttaacaattagtattttacttatcacctaaagtataaaacaaatatctgtaagtccatattgatataaataattacattaataaatgaggaaagagacaaagaatagactgatctcccttagagaagaattccaaataatggtagattcttccatcttccagagggtcctctataactttccccatctccttggagtgtgggctgcacttagtgacttgcttcctaagagtatggaatgggatgactgtgtgtggaggtggtggtgataatcttacagtggctaaacctgcaaatgctacctgagccaggtggtcgaggctgatgtattaggtgtaaatcatgttggcacgtgcccttgatagaattgttatgaaaagattcaaaccctgtaaaatatttgaaaagatttattctgagccaaatatgagtgaccatggcccgtgacacagccctcaggaagtcctgagaacatgtgcccaaggtggtcggggcacagcttggttttatacattttagagaggcatgagacatcaatcagatacatttaagaaatacattggttgaccgggcatggtggctcacgcctgtaatcccaacactttggaaggccaaggcaggcagatcacttgaggtcaagagttccagaccagcctggccaatatggtgaaactccgtctctactaaaaatacaaaaattagcctggcgtggtggtgcatgcctgtaatcccagctactcgggaggctgagtcaggagaatcacttgagcgcagaaggtggaggttgcctggcccgaaggcatttgtttaatttccttttgcttccaatgtggctgttaagaaacctaaagttggctgggcacggtggctcacgcctgtaatcccagcactttgagaggccgaggcaggcagatcacgaggtcaggagatcgagaccatcctgggtaacatggtgaaaccccatctctactaaaaatacaaaaaattagctgggtgtggttgcgggcgcctgtggtctcagctaccagggaggatgaggcaggagaatggcctgaacctgggaggcggagcttgcagtgagccgtgattgcaccactgcacatcagcctgggcaacagagcgagactctgtctcaaaaaaaaaaaaaaaaaaagcctaaagttattctcgattctttctacgtgactttttttttttgagatggaatctcgctttgtcgcccaggctggagtgcagtggcgtgatctcggctcactgcaacctccgcctcccgagttcaagcaattctctgcctcagcttcccgagtagctgggattacaggctcccgccaccacacccggctaatttttttgtgtttttagtagagatgggctttcatcatattggccagactggtcttgaactcctgacctcctgatccacccgcttcagcctcccgaagtgcttggactaaggcgtgagccaccgcgcccggcctgcatgacctgttttttttcctccctctctggaagtatagagaatattctctgggactgggtgtggtagctcacgcctataatcccagtactttgggaggccgaggtaggaggatcacttgagcccaggactttgagaccattctgggcaacatagtgagaccctgtctctacttaaaaagaaaagagaagagaagaaaaagaatattctcttgtcaccaaaatattttaattttcttaggacaatttttttggggggtcaagttctacctttagaacagtgccttgaataaagtagaggctcagtaaacatttgaggaatggatggatgttactcttttggggctggccagatttctttctttagttctgttcttttctgttctattctgttcttttccttttcttttctttctctctctctttctttctttttctttgagtttctttcttgttgcccaggctggagtgcaatggggtgatcttggctcactgcaacctccgcctcctgggttcaagtgattctcctgcctcagcctctcaagtaactggggttacaggcatgtgccaccacacctggctaattttgtatttgtagtagagtcggggtttctccatgtttgctaggctggtctcgaactcccgacctcaggtgatccgcccgcctcggcctcccaaagtgctgggactacaggcgggagccactgcgcctggcctggggctggccagatttctcgggaaaatttgcctgtcttttttttggaggcgaagacctagctgccctaccaggtctacaaaccaagtggtggctgagagttggtcatctcccaggttccccctggtgctgcctagctcagttcttctgcagctccctgccatgcttgtagtggacatcgcagtcgcacttcttagtttaaagcatccacctaatgcagttgtgtgtgtgttatgctgaacgttgaggatgtgttttgaggaatgcatcgttaagtgatttcgttgtgggggcatcagggagtacatttacacaaacctaggaagtataacctactgcacacctaggctgtatggtgtagcccattgctcctaggctaaaaacccatacagtatgtggctgtggtaggcagctgtaacagtggtaaatatttgtgcaactaaacatatctaaacatagaaaagatatagtcaaaataggtgttacaatcctttttttttttttgagacagagtctcgctctgttgcccaggctggagtgcagtggcacaatctcagctcactgcaagttccgccttctgggttcatgccattcttctgcctcagcctcccgagtagctgggactacaggcacccgccaccatgcccagctaatttttttgtatttttagtagagacagggtttcatcgtgttagccaggatggtcttgatctcctgacatcgtgatccaccagcctcagcctcccaaagtgctgggattacgggcatgagccaccatgcctggcctggtgttataatcttatgggaccactgtcaaatatgaggtccctcattgaccaaaatgtcattatactgcacatgactgtattgtacagaatttgtctattgtaaatttgttagtttgcgtcatatctatcagggagttagttaaaattcccaaggccttctcttttagtcattagtgtgacagagtaagtaaaatatcactcctgtcataaaggacgaattaaaaggacagttttagtgtgtaatgagaactattttctgagacagtcttgcttgctctgtcacctacgctggagtgcagtggcatgatcatagctcacgcagccttgaactcctgggctcaagccatcttcccacttcagcctctcaagtagttgggagtacaggcacatactaccatgcccatctaatttttaattttttaattaaaatattatatgtatgcatatatatgtgtatatatacatatttcagacaaggtctcactctgtcacccaggctgaagtgcagtggcacagtcatggctcactgcagccgtgaactgcagacatgcatctttatgcctagctaattttttttctttcttttttttctttttgaaaagatgggacccctctatgttgcccagtctggtcttgaacccctgggctcaaacgatgtttctgcttcagcctcccaagtagctgggagtacaagcatgtgccaccatgcctagctaattttttttgtttttttgtagagatggggtcttgctgtcttgcctaggctggtcttgaattcctgggttcaagggatcctcccacctcatcctcccaaagtgctggggttacacacatcagccacagtgtccagcataagaactatttctatttttcatattacctctgcttggattactttagaggtaaagcaactgaatatacaaattcatatttatgtctggtgtttttgtcagagctgagtggtagaactttcgttgtagtctgtatattaggttttattgcatgccatctcttttcagttacacgggtacaaatccttacctgtcaagtaggatgttgaataatacaaacatgctacagttaccttgtctatccgaactgttaagccttatttcaagtttgagcatgggttttttatttactttctttatccagaaactttttttttatttttatttttttgagacggagtgttgctctgtcacccaggctggagtgcagtggcaggatctcggcttactgcaacctccactttccaggttcaagcgattctcctgcctcagcctcctgagtagctgagactacaggtgtgtgccaccacacccagctaatttttgtatttttttttttactagagatggggttttgccatgttgaccaggctggtcttgaactcctgacctcaagtaatccgcctgcctgggcctcccaaagtggtgggattacagggagagccactgtgccttacccagaaacttttttgttattgtttcttatatttccaaaaggcaggtaagccttttgaaaggatggcatggccaggcatggtggctcacgcctgtaatcccaacactttgggaagccaaggtgggcagatcccaaggtcaagagatcaagaccatcctggcatacatggtaaaaccccatctctactaaaaatacaaaaattagctgagcatggtggtgtgttcctgtagttctagctacttgggaggctgaggcaggagaatcgcttgaacctgggaggtggaggttgcattgagccgagattgtgcaactgcactccagcctggcgacagagcaagactccatctcaaaaaaaaaaaaaaagaatagcatttcctaatttctgtcccagtgggtagtttgtaaaagaccaggtctatttgtattgggtttttttttcttttgagacggagtctcgctcttttggcaggctggagtgcagtggcgcgatctcggctcactgcaacctctgcctcccagattcaagcaattcttctgcctcaagctcccgagtagctgggactacaggtgcacgccaccacgcctggctaatttttgtatttttattagagacggggtttcaccatgttggccaggatggtctcaatctcttgacctcgtgatttgcctgccttggcctcccaaagtgctgggattacaggcgtgagccaccgcgcccagcctgtattgtttttcaaatgacattttaaaaagagtaaaaattgttttatttctaggttacaaaatgctacagacaggattttaacatttattttgatttattttttactcctggcaagttgcgatacaggtatttaatcagaggtcccaatgtggagcctgacaggataggttcttaacattctcaatttatgtcctcagaatgtggtagtacgaaagaatgattgaagtaaatctttggacttgagacttgtggcctggcatggtggctcatgcctgtaatcgcagcactttcggagggtgaagtggacaggtcacttgagcctaggagttgaaggccagcctcggcaacatggcaagaccctctctacagaaaataaaaagaaaataaaaaagaaagaaaaattagccaggcttggcggcacgcacctgtagtcccaactacgtgggagactgaggtgggaggatcacttgagcccaggaggtggaggttgtaatgagccaagatcatgccactgcacttcagcctgggtgacagagtgagaccctgtctcagacaaaaaaggagaatcatgtatgttaaaaatacatgtcaaaatggcacagtgggctgggtgcagtggctcatgcctgtaatcccagttctttgggaggccgaggcgggcagatcacctgagctcaggagtttgagaccagcctgggcaacatggcgaaactgtgtctctactaaaaatacaaaagttagctgggtatggtggtgcatgcctgtagtcccagctacttgggaggctgatgtgggaggatcgcttgagcccgggatgcggaagttgcagtgagccaaaatagtgccattgcagcccaccctgggtgatagaatgagagcctgtcttaaaaaaaaacaaagaaacagtacagtgacaattgcctatactcctagctccttgggagactgaaggtggggaattgcttgagtctaggagtgcaagtccagcctgggcaacatagcaagaccccatctctaaaagaaagagaaaaacatgaaaaccacaatactatataattgcaaaagttgagtcactatctaaaataatgtaaacaaaatgagttctaaaataaaaataacaattatagggtttttttggtcttcattatgttaggtagtgacttacagtctgtagacacagtacataatttgttaggggcctggtgtgatagctcatacccatatctccagcactttgggaggccaaggtgggaggatcactggagcccaagagttttagaccagcctgggcaacatggtgagacctcatctcaaaaaaaaaaaaaaaaaaaaaagaatttgttaggtttacttgaatcctgagactttaaatttagtagactgtaatagctttgcctgttgaacaatagccttaaagaggtttgaccctaaaaagggcttcttatgtgttttttttttttttcgagacggagtctcgctctgtcgcccaggctggagtgcagtggcgccatctcggctcactgcaagcttcgtctcccgggttcacgccattctcctgcctcagcctccggagtagctgggactacaggcgcccaccatcgcgcccggctaattttttgtatttttagtagagacggggtttcaccgtgttagccagggtggtctcgatctcctgacctcgtgatccgcccgcctccacctcccaaagtgctgggattacaggcgtgagccaccgtgcccggcagcttcttgtgttttgggagcttaattcagatgttagatttatcaggttttacactggagattttgcattgagttcttttggtctcacggagtaaataatggaactttaaataggactttttttttttaaggaataaaagcataataaaaaaagttcatagttagaataacctggggccagatagcttgtgtgtcagtcagagggaaagagggaagggagtatttctgagcctgtactattgttccaggtcaggtgggtatcaatttcacttgacgtacagggagactgagcctccaccacaccccagggtaggtgagaagaagatgcattagctccaaagctgcttcattcattcattgcacacatctttattgcatgcccgtgggttgctaggcattgttttggctgattccttgttccattgaatcatctccaggcatacacggcatgagagttggaagatggtccagtgatggtgtgatttataggctggcaaaatgtttgagtcaacttagatactgagtaatttttaccttgcagaaatcagtaaatcagtgttacctgttacttagcggtagcctgtatactttttttttttttttttgagatggagtctcactcttgcccaggctggagtgcagtggtgcgatctcagctcactgcaacctctgcctaccgggttcaagcgattcttctacctcaacctcccgagtagctgggattgcaggcacctgccaccacgcctggctaattttttgtatttttagtagagacggggtttcaccatgttggccaggcttgtctggaactcctgacctaagtgatctgcttacctgggcctcccaaagtgctgggattacaggcgtgaaccaccaagcccagccgcctgtatacttttgaattcttcatcttgaggagctgcaagatagttttccctcagaaacgcattttgtttctgcatcaaacttgaaaaatgtcctaagtagacttgtcagtcgtttacagttttataccttatttatttatttatttagtgatggagtcttgctctgtcgcccaggctggagtgcagtggtgagatctccgctcactgcaacctccacctcctgagttcaagtgattctcctgcctcagcctccataatagctgggattacaggtgtgcaccaccacgcccggctaattttttgtatttttagtagaaacgggtttcaccatgttggccaggctggtcttgaactcttgacctcgtgatccgccagcctcggcctcccagagtgctaggattacaggcgtcggccaccgcgcccagcttgccattacttttattcatagaatgatctttagtttgacctacgtgcatatagacttttgcctgtatttccttctagtttcttggtttttttttaatttagttattaatctggaattcatgttagtatatagtgagtgtaggagtttaactttattttatttttcctaaatagccagttgccttggcaccgtttattatataagctgtctttggttataatggcttagcctagaaatggtgagaggtatcgagtctaaatatacatgccgctgtctgtttccctctgaagaagtggcacgtgtacttaacatctataccatggtcacctggggggcaggtttcttgtgctctcactccgtgctgctcctctagccttggtactgggtctggctttgcagtgatgagcagctgctcaccagcagtgggtgccgtcacacctctgcctcagctcccctttgctgccgggctggcagtgcccttagcaatcttagtagcccttactagccttgagaggtgctacttgataacactggcttcccttgggagtggtttcttctgtctggccttcgtctctcagttggccattgccccccaccaccgtgttccgccacacagccactgtccctgagccttcaggtctttgtgcacctgcttgtgtagcttgtcttctgctagcttgcatgtccccaagggcgaggcccttattaatctgtacattccagggcttagctcagagtaagttttagtaaaacacttgcatctgctagtttgggaaacataaaagaatatatgttgcatcatttggatataatacataaatactttgctgtcagggtggaaaaacaggccttaagttttattttcctcctcctgaagacccttcccttcagtcataggaacctcaaagatgttcagatcaacactttaacctagtacattttaatcttgtttgttgaaaactggtccttaagtgttttctttcactcattttacaaatgtgtattgagtgccaggccggggatatatcatggaacagtatggatgaggtccctagtggagcagcagtatcactcagcaatatattcccagcctggcacaccatggatttgctacagtgaagctggagagccctgtgttaaataaatactaacagttaacatactgtcaggtagaggagtggcctttgttcttttttttttttgagacagaatcttcctctgttgcccaggctggagtgcagtggcgcgatctcggctcactgcaactcctgcctcctggcttcaagcgattctcctgcctcagcctcctgagtagctgggagtacaggcgagcgccatcaggctcggctgatttttgtatttttagtagagacgggggtttcaccatattggccaggctggtctcgaactcttgacctcgtgatctgcccgccttcgcctcccaaagtgctgggattacaggcatgagccaccgtgcccggtcggcgtttgttgttttgttgttttctggcctctttgttagtggagtggaggtggatttctgaatagtcttacagacaacttccaaattttaaaaggaattcagtcttcatatgtatggaaaaagaaaatcatttttccagtgtgtgatgcagagactaacgtgaccctattctcaagcactcatagcttcaccccaaaatcctggaatatatagtctgtatctgctgattcagcttttcttcccttcatgcagcgtctgtcagtccatccattcactacatggactttctgggccaggagctgcctctagaagctgtggagtcctacaagatcaagtccctgccttttttctttttttgggaattttttaaagagacagggtcttgctccgtcacccaggctagagtgcagaggtaccatcatagctgactgtcacctcaaattcctggactcaagcgatccttgtgcctcactgagcctcctgggtagcaaggaatacctgcacataccacccagctaattttacttcatttatttttatttatttatttaggcagagtctcgctctgtcacccaggctggagtgcagtagtgagatcttggctcactgcaacctctgcctcccgggctcaagtgattctcgtgcctcagccccctgagtagctgggaccacaggcgtgtgccagcacactcacctaatttttgtatttttagttgagacagggtttcgccgtgttggccggctggttttgaactcctgccatcaagtgatccgcctgccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctggccctggtggtgcttcgctgtgccatcctcatctgtgagcctgcccggtgaccgtgctgcacctgtccttgatgccctgtgtcttccaggtctgctcctcccctgctgctcttcctgttccatgttctttggctggtttttctttcttcttccagctgtgtgactccttttcaagcctttgtccagttaaacattttaccaagaatgtagtgttcttcctgcatttcattaggaagagaaaaaggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgtattgattgattgattgagatggagttttgctcttgctgcccaggctggagtgcagtgatgcagtctcggctcactgcatcctctgcctcctgggctcaaatgattctcctgcctcagcctcccaagtagctgggattacaggcatgggccaccacacctggctaattttgtatttttagtagagacagggtttctccatgttggttaggctggtcttgaactcccaacctcacgtgatccacctgcctcagcaaagtgttgggattacaggcgcgagccaccatgcccggcctctgaattttatttttatttttatttttttgagacagtgtttgctctcgccgcccaggctggagtgcaatggctcaatctcagatcactgcaacctctgtcccccgggttcaagtgattctcctgcctcagcctcccaagtagctgggattacaggcacataccaccattcctggctaattttttgtatttttagtagaaactaaaatgttggccaggctggtcttgaactcctgacctcagggcctctctgaattttgaaaagcggatccaaaatagtggatactgctgtgtatcatttaggatttgatttggctgccagtatcaaaaaaacaaaaacagtggcttaaaccacaagatgtttgtcaaataagtactgaggtacactctcctggacgggttctgtagctacacagtcatcggggatactcaggttcctaacatctgccacactgcaccttggcagcctgtcttggggactgagagtgagctccatgtggccctgttctagcataggggaagggaaaggaaggacgtgcctccttccttgaaggctgctgctttgatgatgtgtacagcagtgcttacattgcattggccagaccttatggctgtacctgggtgagtgggagactggggaatgttgtcttcccacttacagtggcaggtccttaagcctaaggaaggagaatggacactggccagtgggtgatggtctctgcaatcccagggccagattgcttcatatctttgactaacctttgtttctataatatcatgcttgacatagagatgaaaacactggaaacatctaggtttttaaatactctctcctgataacttctggctctgtcagcatatcttaggtaaaattaaatataccaaagctttgcttctttcttagcattctctagtttagtgagtgaatagagcagaagaggggctgctggccagcggtttctgctttcatagaggaagtgactgcccacaccctgattttagagtcttcatcctaaccatgttacagccttgagttgcagaactgtagctctgtttggatattgtgaacgtattatttctcaagttctgttaccttgagaacaggtgacatgaatttaaacttgcttttttggtgtcgcagataagagttttaaaaaaagaaggaagaaaaggtcccaccttctggagtttcaggttttaaacctaggaggataataacctggttattatgttatgagagggatgggcagatgtatgttctaaagagagaacagattgctgccagccagctcctagctgtttgtgctcttatgctcctaggaacttgccacagcctcacgctggtctgttccagaaaccagtgagcactctgtaggcagagccctggagtggcccctggattttatgacataaacataagcttatgagtgcaccagtgcattcttactcttggtggtagctacagagatgtcttctctcaccttggaacatcaaggaagatttgtatgtgcactgttctctgacccccacttgcagcccttcaccaacatgcactctgtgcgcagacatgcatgtgtgtacacgaggtcttacacatgggaaagggtctataaaaaattatgttgggcccatcttgatagaaagtaaaataatacagtttcatcagaagggtagctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttttttacaaggagtctcgctctgtcactcaggctggagtgcaatggcacaatcttggcttactgcaacctccatctcccgggttcatgtgattctcctgcctcagcctctggagtagctgggattacaggtgtgtgacaccatgcccagctaagttttttttttttttttttttttttttagtagagatgaggtttcactgttttggccaggctggtcttgaactcctggcctcaagtgatctgcccacctcagcctcccaaagtgctggtattccaggtgggagccaccatgcccagccttctttctctgttggctctatttggatgtttatcctagtctcagttatttttcattcaacatttatttctgattcagttaactttttttttttttttttttgagatggagtctcactctgtcacccaggctggagtgcagtggcacgatcttggctcactgcaacctccacctcccgggctccagcgattctcctgcctcagcctcccgagtagctgggactacaggtgtgtgccaccacgcctggccaattttttgtatttttagtagagatagggtttcattgcgttagccaggatggtcttgatctcctgaccttgtgatctgcctgcctcggcctcccaaagtgctgggattacaggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatcccatcatgagggccccacactttcgagctcatcttatcctgatcacctcccaaaggtttcatctctaaataccattacactgggggttagggctttaacataggaatttggggagaacacagtttagttgacagcatgctatttcaaaaggcttaccaaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctcaaaaaagaaaaaaaaaaaaaaaattaaggccgatgcggtggctcatgcctgtaatcccaacattttgggaggctgaagcgggtggattacctgaggccaggagttcaagaccagcctggccaacatagcaaaaccccttctctattaaaaaatacaaaaaaattagctgggtgtggtagagtgcacctgtggtcccagctacttgggaggctgaggcatggaattgtttgaacctgggagttggaggttgcagtgagccaagatcatgccgctgtactccagcttgggtggcagagggagaccctgtctcagaaaaacaagcaataaataaataaataaataaataaataaaagatgcttgctctagagtgctatggaaatgcaagtactttgcagatgtcgatgccagcagtgattgacctgggacattggaggatgttgagaagaagaaaactggtttcgtaggatcggagacttttaaaatttattattttgaaaaagtgttaaacttggagaaaacatccagtgagctggctctccttaccctttccagagtacttacgagtgcctgtttcttctgaaacctgttcacatagtggcatagcatgtgccacggctgcttactgctgctgggcgtctttccctagggtgaggggttctcctgtggcagtccagggccaagggcactcaggaaattgcacacagacccagtatgtcctctcctctgcagctcatactctccttttgttaactgccaacagcatccttcatggcattgtttcactgtgtcccagggtccagttcaggggtacatcctgcatgtggccgtcacatctgttgagtagcctttcacgtggaatggggtctctgtctctggttgtctttcatgacattggtgtttttgaagaatgcaggccagttattttgtccatcattcctcagttggggttcgtctaatgcctggattatgcatcccagacaggaatattctaaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctcggtgcagtccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacaggctagtcacttttgtttacctactgaattttacctagagacaatgtttttaaccatcttgccccttaaaatatatttttatgtatctgtataaactatttttcaaccatatccacttctctttaaacaggggttaaattaaaaatatttagcaagcttttttttttttttgagacggagtctcgttctgtcacccaggctggagtgccggggtgtgatctcggttcactgcaagctccgcctcccgggttcacgccattctcctgcctcagcctcccgagtagctgggacttcaggcacccgccaccatgcctggctaatttttttgtatttttagtaaagacggggtttcatcgtgttaaccaggatggtctcgatctcctgacctcgtgatccgcccgcctcagcctcccaaaacgctgggattacaggcgtgagccaccgcgcccggcctatttagcaagctttgtggaagggtgtcactgaatcagaagaacagatgctgcccgtgaccactcagttcagcttgtttagaatagaccacagtgtacccctaacgccagccaaacgaagctgttttgaccttttccacaagaccctgtgcaggcggcttcttttgtctaaatagccttcccacttggcctggcggtgtcttcctgccttctgaggcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcctcaccttcctgagtagctgggaccacaggcatgcaccactacacccagctaaattttatatatttcatagagacagcgttttgccatgttgcccaggctggtctcgaactcctgggcttaagtgatctgctcagctcggtaccccatagtgctaggattacaggcgtgaaccactgcacttggccaaggcttttttttttttttttttttttttaaacttatatgcccattaaaacatatggaagtttctggacagcactggatattattaatataaatgagttaagtaagcataactaggtttttgttgtgcacagcgtgcatgggcacacacatcactgctgggtgctggggatgccatggcctctgtcagtcttgtgtttttccctagcattatagtgtgagagttgacccacgtgcgtagatgtttgggaaaaaaatagtagctacatatgtattcatattcagtattctacctttcagcttgttatttcatcattcttgtattaagggacacataattttaagctttttttttttgcctttaatattttactgatctttataaggtttgttcaagattttggattgattgattggttgtagagatggagtctcaccatgttgctcaggctggtctcaaactcctgggctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttgggaccacaccggagaaccactgctaactaatagtcccagacattttataatatgtcatcgtttacagaagtgtttaatatacctcatctcatttaattcttttttttttttttctgaaacgaagtcttgctcttgtacccctggctggagtgcaatggtgtgatctcagctcactgcaacctctgcctcccgggttgaggcgattccacccaccccggcctcccaaagtgctgggattacaggcgtgagccaccgtgcctggccattttttttctttctttttttttttttttttgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtggcacgatctctgctcactgcaagctccacctcccaggttcacgccattctcctgcctcagcctcccgagtagctgggactaaagccgcctgctaccacacccggctaatttttttgtatttttagtagcgatggggtttcaccatgttagccaggatggtctcgatctcctgacctcgtgatctgcccgcctcagcctcccaaagtgctgagattacaggcatgagccactgcacccggccctgtggtttttcttaaatagtttaagcttaacttttatttctgtagttgaaaattacatttaaaaaagctgtagtgaggccgggcacgatggctcatgcctgtaaccccagcactttgggaggcctaggcgggtggatcatgaggtcaggagtttgagaccaccctggccaacatggtgaaatcccgtctctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttgagatggagtctcgttctgtcaccgggctggagtgcggtggcgtgatctcggctcactgcaacccccacctccatggttcaggtgattcttctgcctcggccttccaagtagctgggactacagggacacaccaccacgtccacctaatttttgtatttgtagtagagatggggtttcaccatgttggccaggatgttctcaatctcttgacctcctgatccgcccgccttggcctcccaaagtgctgggattacaggctgagccactgtgcccggcgctgttttttgtgtttttaaaaatttttcggttttaggttttgagaaataaccactgtgatgtgtttttaactgactattagctgaaaacaactcatttaattagagaatagcccacaaaacaaagccagattggcccatacaaatcagtgtttaagactcaattacaggctgggtgcagtggctcatgcttgtaatcccagcactttgggaggccaaggtgggaggatcacttgagcctaggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaacatgattaaagataaattcaccaaatatgctttatgaagctgaaaaatgaaataattattattataactaaagattaactcagagctatagattaagtcaatgtcatatatatttaataccagctgctacagttcatggtaattaggtattaaaaaatataacaacttgttcatttcagcagtgctgtgtatgacaatctctttagatgttatgaagattcgggtattgggtctatccgatgagtgaccacaaattgtgtttttttttttctgaaacggagtcttgctgtgtcgcccaggctggagtgcagtggcacgatctcggctcactgcagccttcgcctcctggattccaggaattctcttgcctcagcctcctgggtagctgggattacaggcatgtgccacaacacccggctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggctaggagaagagcatcctgggcaactgggacagctgtgggctcttcagaagctggcagtaaaactcacatagcctttacaaagcccatttccttatcttcaaaatgtgcctaatgtgtacatttgtacatagtacaaccaatgtacaaaaatataactaccatgaaggattactacagtaattaacacagctaaagaagatgagcacagttccctccctcccctcatgaataagaatttgagaaattctggttattttattactacgtggtgtagcgagccagttaaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaaaaaagacaccacagactaagtgacttgtgtgaggccccgtagctgagaagcagttagactgggattacagtgcccagagcccataacatgtcctcattgcagagacctatacagttcacgcagaaatggagacaggagcatcacccaaatccatcttcatgtcctcattgcagagacctacccaattcatgcagaaatggaaacaggagaatcacccaaattcatcttttcacatttttaatgtctttccttccttctgtgcctttggtttacagatttcaaaccataccgtccatatcatcatgtatactgcttattttctttacatttttagtgtgagtacctttcagtcataaaaatattttcataaacattacttttaaggtggctttttcctccatagcatgggtctgttggttgtctagaaacttgcgtgagtgttccgagaagatgacttaaaacgaatattgattcgtatgcttgttttcttttttttttttgaggtggaatttcgttcttgttgcccaggctggagtgcaatgatgtgatcttggctcactgcaacctctgcctcctggattcaagtgattctcctacctcagcctcccgagtagctgggattacaggcacacaccaccacgcccggctaatttttgtatttgtagtagagacagattttcaccatgttggccagactggtcttgaactcctgacctcaggtgatcctcctgcctaagtcccccaaagtgctgggattacaggtgtgagccactgcacccggccttgatttgtatcttttctacttttgctagcaacatcttgctactttttcttagactattgtttaatgtttttgtttagtgctcacattctgaatactcccttgtgctacttgagcagctggcattttagaaattacattccagggccctagcatttgctggggtgtcttgacagttgctcacctgtctcaggacattgattctgtaccctgtgtcttacctgttgcttggtgtccagctctgtcgtccatagactttttcctccagtgtgaacctaatctgtccatgctgtaagaagtagtatctaacaaggatcatataaaaaagaaaacaggctgggcgcggtggctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgctggagacacagatccacacacactccttttcctcacagcccatggggccttgtcctctgcagagggaagtgtaggcccctccgtggccggcccgagagccttgcctcttgagcccgagcctgtgcagactgccctctgtgatggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaattttacagtttcagaaaagtacaagagaaagttaaaatatattcaagccaaaacagaagtctgttagttctttagattatgtgctgttgatagtggttgttcagagcttatatgtcatagttctgtatgtcatgtgctttcttacagtccaactgttacaaccactctaaaaaaccttggggcactttacagacgtcaaggcaaatttgaagctgcagaaacgttagaagaagctgctatgaggtctcgtaaacaggttagtcatacttctgtccttaaccggcccatgggaactttgaattgaatgcttctcttttacatgaattttattgaaagcttgatttagaaatagaaaatgttgattattttagtttgaacaaataaagttatattgtttaaaagagcatgaggccgggcgtggtggttcacacctttaatcccagcactttgggaggccagcgtgggcagatcacctgaggtcaggagttcaagaccagcctggccaacatggtgaaaccccgtctctactaaaaatacaaaaattagctgggcgtggtggcacacgcctgtaatcctgtaatcccagctactcgggaggctgagacaggagaatcgcttgaacctgggaggtggaggctgcagtgagccgatatcatgccactgcactccaacctgggtgacagaacgagactccgtctcaatttaaaaaaaaaaaaaaaagcatgaggctgggcacagtggctcacacttgaatcccagcactttgggaggccaaggtgggtagattgcctgaggtcaggagttcgagaccagcctggctagcatggaaaaaccccatctctactaaaaacacagtgcagtggcacaagcctgtagtcccagctactggggaggctgaggcaggagagtcgcttgaactcaggaggcagaggttgcagtgagccgagattgcactactgcactccagcctgggcaacagagcgagactccgtctcaaaaattaaaataaaataaaataaaatagcatgaatatgaccccaaaagcatgaacagcaaaataaaaactagatctgttggattcaccaaagttaaaagctcttgtgcatctaaggacatcatcaagaaagtgaaaggggactgggtgtggtgctgagcacctgcaattcctgcacgttgggaggctgaggtgggaggatcccttgagctcaggagttggaaaccagcctgggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaagaaaaaaaaaaagaaaaagtgaaaagacccccatgcaacaggggaagatatttgcaaatgatgtatctcataaggttttggtatccagacaaaaagacaacccagttaaaaaatgagcaaaggacctgaatacacattttactgaagatgatatacagatagccaacaatcacatgaaaagatactcaacatctttagtcattatagaaatattaactgaaatcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccgagacaagaatcttgctctctcgcccaggctggagtgcagtcacgctatctcggctcactgcaacctctgcctcctggttcaagcaattctcctgcctcagcctcctgaggagctgggattacaggtgtgcgccaccacacctggctaatttttttatttttagtagagacagggtttcaccatgttggccaggctggtctctaactcctgacctcgtgatctgcccgcctcggcctcccaaagtgctgggattacaggcataaaccaccgacttttcttattttttaaatggtagggcagtatgcacataggtattaatttttaatcaacttttttgagggataattagagacagtaaaaggggcccattttaactgttgtctgatttaaatattaacacggttcaggtcagcacattagtttgtctttatatagatgttagaacaaagtttctcatgctgtttctgtttaagtgaaaatttccctgagattgcaaagcaaaccgttaccactgtagccacttacttgtgtgcatcaagatttttttcagtattatgcaattaagttaaaatagagacataggtgttgaggtaaatgttaagactataccttgccgggcgcggtggctcacacctgtaatcccagcactttgtgaagctgaggcgggcagatcacgaggtcaggagatcgagactatcctggccaacacggtgaaaccccctctctactaaaaatataaaaaattagccgtgcatggttgcgggcgcctgtagtcccagctactcaggaggctgaggcaggagaatgatgtgaacccgggaggcggaccttgccgtgagccaagatcacgtcactgcactccagcctgggtgacagagcaagactctgtctcaaaaagaaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttgaaacctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtg

SEQ ID NO: 1296 - DNA, 17871 bp, Homo sapiens; identical to SEQ ID NO: 1294

SEQ ID NO: 1297 - DNA, 17871 bp, Homo sapiens; identical to SEQ ID NO: 1294

SEQ ID NO: 1298 - DNA, 17926 bp, Homo sapiens; identical to SEQ ID NO: 1293

SEQ ID NO: 1299 - DNA, 72365 bp, Homo sapiens
cggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctccaactaaacttgaagcagcctccgtcctggaatgctttttccatgtaaaattgggtgtacccttttccttaagaaaattaaaataaagcgtaaaagtagtgaaattaatgcgtgatggagtggatggttttataacttaacatttgtaggtcatttctaggtatatttgtattagaattgttgctgcctgttactgttttattatttaaatgaattaagaatttacatattaagcgtttgaaaaggaatacttacaaaaatgatgttttttaaaaatgtgagaacaaaaaatttgagatatactatttcaggtgttctgtaaaagggcagttagagctttgattctttgcattagttaaatcccaaggcctttttttttggtacggcatgactaagccattgatcagaatcagctcggaatacattgcactagtttagtgaaagacactttagaaaactggaagaacctcctgaagttatattacagacatggccttgcttctttcagggattgtcagcaagcctgttatggtgagaaatttgacctattgctctgtttcctaaatatttgtaggaatacaatgatactaagtatgaagtatatttcaacttgtatggaattctgtgtgggagggtaggcactctaaagagccagtgtctctccaagtcatcaaagaatgcagcatcatgttgcagttgagcctggcagccctgtctggcactgagtgctgtggaggacccaggtggtaacctctaaccctactgcagccttggcattgtcttagagaaaagcatccagacatgcacaggactctggacagcgtttatctccagcaaggggggagggaatgacactggggagaggcacacagtatcttcagtatttcatagcaaataactgcagtcgtttaaacttacacattttttttttttttgagatggagtctcgctctgtcgcccgggctggagtgtagtggcgcgatctcggctcactgcaagctccgcctcccgggttcacgccattctcctgcctcaacctactgagtagctgggaccacaggcgcccgccaccacgcccggttaattttttgtatttttagtagagatggggtttcaacatgttagccaggttggtcttgatctcctgacctcgtgatccgcccacctcggcctcccaaagtgctgggattacaggcgtgagccaccgcacctggcccaaatttatacatttttaaaatttatacattcttaggcatgtttctcaatgttggaaaaaagtcaatgtgtaactttctgtatagggccataaattatcttaaaacatacttgtataaaaagaaacctaggatagaaaaatcaaaagttgagtgaaatgtatgattagtatcacctgaaaacattctttgtagataagtggaatgttagaaaccagtattttatttttatttatttagagatgagtctcactgtgtggctcaggctagagtgcagtggtgtgatccccgctcactgcaacctccgcctcccaggttccagtgattctcctgcctcagcctccctagtagctgggattacaggtgcccactaccacaccaggctgattttttgtatttttagtagagacggggcttcaccatgttggccaggctggtctcaaactgctgacctcaggcgatccacccgcctcagcctcccaaagtgctagggttacaggtgtgagccattgcacctgggctgaaaccagtattttatgtagcaaagaaatgatcagtaatatactcaagacgagagtatttgggaagatttaagtgtcaaatttcagggcatagaataaaagtgacaagcacattaagattgcaaatactggtcttaaatgtctgttgggaaccaactgaatggcaggtactgtgctgagtagtcagcgataccttgataaaagagccactgttggccgggcgtggtcatgcctgtaatcttaactctttgggaggctgaggctgcagatcgcccctagctctttgggaggccgaggcaggtggatcacctgaggtcaggagtttaagaccagcctggccaacatggtgaaaccccgtccctaccaaaaatacaaaaattagccaggtgtggtggtgcacacctgtaattccagctactcatgaggctgaggaaggagaatcgcttgaaccgggaagtggaggttgtagtgagccgagatcacgtcactgcagtccagccagactccgtctcaaaacaaacaaaaagagccgctgtcagccgtgcagtggctcactcctgtaatcccagcactttgggaggccaagatggaccgatcacctgaggtcaggagtttgagacccgcctggacaacatggtgaaaccctgtctctactaaaaatacaaaaaaaaccaaaaccgggtgtggtggcgggtgcctctaatcgcagctactcagaaggctgaggctggagaatcgcttgaactggggaggcagaggttgcagtgagccgagatcacgccattgcactccagcctgggcaacaagagcaaaactctgcctcaaaaaaaataaaaccaaaaaacaaaaaaactctgtcctctaggagctcacaggctggcatgggcaggtaccacagaccaggttaaaggctgtggagtgcactgaggaggcgattcttcacaaaagaaaagtaccaatcagccagtgtcagggggtcaggggtgggattgggattggggttcctgcttggaggaaataaatcctgaggttgtgctgctgtaaaggggcatgttgggaaggggacatgggagtgagtgtggaaagacgaggttaggaaaggccttgaatgacttcttagaagtctgctttcattctgaggtttacaaaggagggttggaagattttttttttttttgagatggagtcttgctctgtcacccaggctggaacgcagtggcacgacctctgctcactgcagcctctacctcccaggttcaagtgattctcctgcctcagcctcccgagtagctgggactacaggtgcgtgccaccacatccggctaattttttgtatttttagtagagtcggggtttcaccacgttagccaggatggtctccatctcctgacctcgtgatccgcccgccttggcctctcaaagtgctgggattacaggcgtgagccaccgcgcctggccggagggttggaagattctgaggagccagttgccactttagaaagagcataggcagtggtggggcaggtgctgtgaactgggatgaggttaattaggaagccattaaccccaactcggcaagcctcaggattagggcagtgacagaaggaacagagaagctaggtgggggcaggggctgggctgtaagggttatagtggagctgatttggggctgactggattggggtaaatgaggagctgcagggaggactccccagaatgatcctgtgaaaacctgagtcactcctctgttaaagcttttgtcagtgtcctctgagcaccccaccctgtctcttttcatcttcctgctctggccctactcaagcacttccaggtgcatctggagttctgaaccaaacccattcttgtagtgattagcatttcttcacttccccacatactccttagcctctgccctgatttttctccttagcacacctcactatcttaaatgctgtattattattattttttttttattattactttttgagacggagtctcgctctgtcacccaggatggagtgcagtggcatgatctcagctcactgcatcctctgcctcccgggttcaagccattctcctgcctcagcctcccaagtagttgggactacaggcatgtgccaccacacctagctaatttttgtatttttagtagagacaggatttcaccatgttggccaggctggtctcgaactcttgaccttaagtgatccacctgcctcagcctcccaaagtgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaatctgaagtgcttgtggggcagccaagtggactagtgggcagttagagatacatctttggagctcaagacagaggctgaggctggaggtaaagattccagagactgcatcatatcgttgagccagtcgggtgtgatgtccatctggtagagatggggagtgggtctaagaggagagggtcctgggaaaccaagagaagaggagggaggagatcagtagcaaattggctaagaagtcagtgatgggttggactgagaagtctctatggattttgcttctaggaggttactaatgacctttaacttttttttttttaaatatagtttatgtagagacgggggtctcactgtgtttcccaggctggtctcgaattcctgggctcaagccatctgcctgccgtggcctcccaaagtgtcgggattacaggtttgagccactgcacccggcctgttgcctgtttcctgagaatattacctcttaaggatggaggctatttcgagatgatcttcattcgttctcccaaggcatcctttgtggcgttgtactctgtagcctcctagttagtatactcatggatcagaaatgaattatgatttttttttagttttaactaatttttggaggcagatgaaagcagtttgcatatatgctttttgaatttgaaaagtgctatctgaacttaaagcaacggatatggagcaaacatgttaagctgagttacgtgcatacgtgaactgagttacttccttggttctaaaatatctgttaccttcatttaaaccatagattgttccctgacttcagttgcataacataaatttatgttcaggcttctctgaagttcactatgctgctactaaaactgatcagagtgatgtttgcactgttccagagaaaataggtactgtaaaccctgcggatgtcatatgtgtctgtagtttcagttactccgaaggctgaggtgggagaatcagttgagcccaggagttcaaactagcttgggcaatatagtgagaccttgtttcttaaaaaaataaaaggctgtgcttggtggctaatgtctgtaatcccagcactttgggaggctgaggagggcggatcacctgaggtcaggagtttgagaccagcctggccaacatgggtgaaaccttgtctctactaaaaatataaaattagccgcgtgtggtagtatgcttctgtagtcccgggtatttgggaagctgaggtaggagaatcacttgaacccgggaggcggaggttgcagtgagccagatcgagccacggcactccagcctgggcgacagagtgagactcccatctcaaaaagaaaaaaaaaaagtaaaataggtactgttactgagattctactgttgaggaatttgagggtgagagaggggaagtttcagaaaccaaagttacacagctgtgaagtcaagattctaactcagtttttttgcttcgcggtataagctttgaatcaccttgcagtacttaaagctgcagcttcaagtgaatcatgataatgctgtttaatcctatcattactttttcttggggaaacctcgcgccacttcaatttttttcaaagatgtaccattttaaccatttaaaagttcacaattcagtagtgttaaggatatgcacatcgttgttccacatttctggaactctttcatctggcagcgctgagactgtagcccccaaatactgatatctcctcctccctcgccctcccccggtaaccatcttttctactttgtttctatgattttgactactttcaatactttattttttattttttttgagatggagtttcactcttgttgcccaggctggagtgcagtggcacgatctcagctcactgcaacctctgcctcccgagttcaaacaattctcctgctttaatttcctgagtatctgggattacagtcatgggccaccatgccgggctaattttgtatttttagtagagatgggtttctccatgttggtcaggctggtcttgaactcctgacctcaggtgatcaccccccatcggcctcccaaagtgttgggattacaggcgtgagccaccgtgcctggccttgcctgtctttttcatctgagccattctagcggggtatagtggcatcttgttagttttaatgtgcatttcactgatgactcataatggtgagcgcttacatgcttgtcggtctttgtatgcctggatttgtaaagtgtctgttcaagacttttgcccatttaaaaaattggattgtttgtatttttaagttccttacatatttatttatttatttatttttgagatggagtctcctctgttgcccaggcttgagtgcagtggcgcgatctcggctcactgcaagctctgcctcccgggttcacgccattcccctgcctcagcctctggagtagctgggactacaggcgcctgccaccacgcccagctaatttttttttttgttgtatttttattagatatgggtttcaccatgttagccaggatggtctcgatctcctgacctcgtgatccgcccgtcttggcctcccaaagtgctggtattaacaggcgtgagccaccacgcccagcagttccttacatgttttttttttttcagatggagtcttgctcttgctctattgcccaggctgacgtattttttatacaagccgtttgccagatatatatgtgtcgcaaatattttttcctaatctatggcttaactttattttttggtagtgccttttaataaatcaatacttttaatttttcttaaccatgctctggcaagttttattaaagaaattttcggctgggcgcggtggctcacacctataatcccagcactttcggaggccgaggcgggtggatcatgaagtcaggagtttgagactaccctggccagtatggtgaaaccccgtctctactaaaattacaaaaattcgccaggcgtggtggtgtgcacctgtagtcccagctacttgggaggctgaggcagaagaatcgcttgatcccgggaggcagaggttgcagtgagtcgagattgcgacactgcattccagcctgggcaacagagtgagactctgtttcaaaaaaaaaaaagaaattttcgcagggtttatttttatcttttattttttgttgttgcctaagcaacatccgctttccttaattctgaaagcatatctataaataagtcacccaaaggccaaatagatgcatttgttttgtctggttgttaatgttttctttttaaaaaaatatttatgtatttatttaatttttgagacaggatcttgctctgttgcctaggttggagtgcagtgtcacagtcgtggctcagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctcttttagaaaattgaaatgtaagtcacatcacatcaaatgccccattttaaagcgtgcagtgcagtgatttttaatgtattctctgttttgtgcaactaccatctatctaattccacacattccttttccctttttagtgcttggtgttttttttttttcttaactttcttcatcactgtaagctttccccacctggctgaatttcacatgataaaaccaggggaggtaaagtgaccaaagatgatgccctttgcttctctggcctttgctttcatttcattaatttttttttttttttttttttttgagtcagagtctcgctctgtcacccaggctggagtctgggtgtatatgtatgaacacagtggggtgtgtgggtgtgtgtgaacatagtggtgtgtatgtatgaacacagtgggggtgtgtgtgcgtgagcacagtggtgtgtgtatgtatgaacataggggtgtgtgtgagcacagtggtgcatatgtatgaacatagggtgtatgtgtgtgagcacaagggtgtgtgtgtgtgtgtgcgtgcatgcagagtggtagggttcctgaagcagagggacacttggggcaaagagaccttggattgtgttcttcttgttggtagaataagcttaaatcacttcatgtatcccagtttcctcagctgtaaatgggaattataatgataggtcatcaaactacctgcagactttttttgttgttatttcgataaaatattacacatttgaaaatgctcccaaaactaacatattggacagatgcgaattcttctttccttttttttgagatggagtcttgctctgttgtccaggctggagtacagtggcatgatcttggctcattgcagcctcagcctcccaagtagctggaactacaggcatgtgccaccacgcctagctaatttttatatttttagtagagatggggtttcaccatgttggccaggctggtcttgaactcctgacctcaagtgatccgcctgcctcagcctcccaaagtgttgggattacaggtgtgagccaccacgcctggctctttcttgtcttttacttatttatttttttgtgacagggtttcgctgtgtcacctaggctggagtatagtggtacagccaaagcttactgtagccttgagctcccaggctcaaacaatcctcccaccttagcctcctgagtagctgggaccacaggcgtgtgccaccacacccaactaatttttatttttgtagagacagggtctcactgtattccccaggctggtcttgaactcctgggctcaagcagtgctcctgtcttggcctcccaaagtgctgggattactggtatgagccaccacacccggcccagatgtgaattctttatttttattttattatttttgagacagggtctcaactctgtcacccaggctagagcacaatggtgcaatcatgtttcactgcagccttgatttcctggactccagtgatacacctcagcctcctgagtagctgggaccacaggtgcatgtcaccacacccagctaattttggtatttttttttaggatggggttttgccatgtttccctgtctggctttgaaatcctgagctcaagagatccacccgccttggcctcccaaagtgctgggattacaggcgtgagccactgagtcaggctgtgaattctttcttttattttctttatttttgagacagagtttcgctctgttgtggagtgcagtggcacgatcttggctcactgcaaactccactttccaggttcatgcgattctactgcctcaccctcccgagtagctgggattacaggtgtgcaccactatgcctggctaattttgtatttttaatagagacagggtttcaccatgttgaccaggctggtctcgatctcctgacttcaggtgatcgacccaccttggcctcccaaaattctgggattacaggcatgagccactgcccctggcctgtgaattcttttttttttgagacagagtctcgcgctgtcgcccaggctggagtgcagtggcgcgatctctgctcactgcaagcgtcacctcccgggttcacgccattctcctgcctcagcctcctgagtagctgggaccacaggcgcccgccaccacgcctggctaattttttgtatttttggtagagatggggtttcaccgtgttaaccaggatggtctcgatctcctgaccttgtgatctgcccgcctcggcctcccaaagtgctgggattacaggcgtgagccaccgcgcccggccctgtgaattcttaatatacatattgtatgtatacttttttggttttgtttttatcaagttatatatgtattttgtatttatgtgtagatttgaaaataaacttttaattttagaatagttacagatttacagaaaagttgcaaagatagtacagagagttcccacatactttgcatccaatttcccctaatgttaatatcctacattactgtgatacatttgtgacaaccaaggaaccaacattggtaccttactattattattactattattttttttttcttttgagacaaagttttgctaggtcacccaggctggagtgcagtggctccatggctcactgcaacctctgccttctgggttccagcaattctcctgcctcagcctccctagtagctggaattacaggcatgcgctactatgcctggctaatttttgtacttttagtagagatggggttttgccatgttggccatgctggtctcgaactcctgcccttaagtgatccacctgcctcggcctcccagtgttgggatcacaggtgtgagtcactgtgcccagcctggtacattattattaactgaactccactttatttggtatcactggtttttcccttgtccttgttgtacctcaggatcccatccaagataccatatcacatttagtcatcatgcctcctgctctgtggctgttttcttagactttccttgcattagaggactgtcttagcttgcgaggctgtaacaaagtaccacaggctagtgactcacgaacaacacaagccacagtcctggaggctggaagtctgggatcagggtgccagcatggtcagattctggtgcagaccctctttctggttgcatgctaccgacttctagatgtattctcacatggtgaaaagagtgtgagagagttccctttttaaaaaaaatttaataataattatttttttgagacagagtctgtctctgttgcccaagctggagtgcagtggcacaatcttggctcactgcagcctccgcctcctgggtgcacttcatcctcccacctccacctcagcctcccaggctcaattcatcctcccaagtagctgggactacaggtgcacactacaacacccagataatttttgtattttttgtagagatggggttttaccatgttgcccagactggtcttgaacacctgagctcaagctatctgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtctcgaactcctgatttcaggtgattcacccacctcggcctcccagagtgctgggattacaggcatgagccactgctcagcccctgggttcccttttttaaaggcactaatcccaccgtgaggggtcccctcatggcctaatcacctcccaaaggccccacctcctaaaagcattactctaggcattagaattttaacatgtgaattggggtggggggcacacattgattccattgcaataaccttgatagttttgagacatatgggcaaggtattttgtacaatgtccttaaatttgggtttgtcttgatatttttcccatggttaagtcagggttatgagtttttaggagaaagactactggctcccagttttggattctgattccattgtaccaaaacaaatcagaactctttggagtaatgggtgattctagggctggggcagggaaaatataagatgagcctgaagcttcttctagtgtttgaatgtaaggatatgctaaaaaacaaagggatgggaacatgaagaagggacacaggaaccaactgaaagagctcccattgacaaaagctggaacaacttgaacaataaaataaataatgtagttttttggttttttggttttttttttttttttgagacggagtctcactctgttgcccaggctggagtgcagtggcgtgatctcggctcactgcaacctccacctcccaggttcaaggcaattctcctgtctcagcctcctgagttgctgggacaacaggcgcacaccaccacgcccggctaatttttttgtatttttagtagagacggggtttcaccattttggtcaggttggtctccaactcctgacctcaggtaatccacccaccatggcctcccaaagtgttgggattacaggcatgagcctccatgcccagccaagaatgtatttttaacaattagtattttacttatcacctaaagtataaaacaaatatctgtaagtccatattgatataaataattacattaataaatgaggaaagagacaaagaatagactgatctcccttagagaagaattccaaataatggtagattcttccatcttccagagggtcctctataactttccccatctccttggagtgtgggctgcacttagtgacttgcttcctaagagtatggaatgggatgactgtgtgtggaggtggtggtgataatcttacagtggctaaacctgcaaatgctacctgagccaggtggtcgaggctgatgtattaggtgtaaatcatgttggcacgtgcccttgatagaattgttatgaaaagattcaaaccctgtaaaatatttgaaaagatttattctgagccaaatatgagtgaccatggcccgtgacacagccctcaggaagtcctgagaacatgtgcccaaggtggtcggggcacagcttggttttatacattttagagaggcatgagacatcaatcagatacatttaagaaatacattggttgaccgggcatggtggctcacgcctgtaatcccaacactttggaaggccaaggcaggcagatcacttgaggtcaagagttccagaccagcctggccaatatggtgaaactccgtctctactaaaaatacaaaaattagcctggcgtggtggtgcatgcctgtaatcccagctactcgggaggctgagtcaggagaatcacttgagcgcagaaggtggaggttgcctggcccgaaggcatttgtttaatttccttttgcttccaatgtggctgttaagaaacctaaagttggctgggcacggtggctcacgcctgtaatcccagcactttgagaggccgaggcaggcagatcacgaggtcaggagatcgagaccatcctgggtaacatggtgaaaccccatctctactaaaaatacaaaaaattagctgggtgtggttgcgggcgcctgtggtctcagctaccagggaggatgaggcaggagaatggcctgaacctgggaggcggagcttgcagtgagccgtgattgcaccactgcacatcagcctgggcaacagagcgagactctgtctcaaaaaaaaaaaaaaaaaaagcctaaagttattctcgattctttctacgtgactttttttttttgagatggaatctcgctttgtcgcccaggctggagtgcagtggcgtgatctcggctcactgcaacctccgcctcccgagttcaagcaattctctgcctcagcttcccgagtagctgggattacaggctcccgccaccacacccggctaatttttttgtgtttttagtagagatgggctttcatcatattggccagactggtcttgaactcctgacctcctgatccacccgcttcagcctcccgaagtgcttggactaaggcgtgagccaccgcgcccggcctgcatgacctgttttttttcctccctctctggaagtatagagaatattctctgggactgggtgtggtagctcacgcctataatcccagtactttgggaggccgaggtaggaggatcacttgagcccaggactttgagaccattctgggcaacatagtgagaccctgtctctacttaaaaagaaaagagaagagaagaaaaagaatattctcttgtcaccaaaatattttaattttcttaggacaatttttttggggggtcaagttctacctttagaacagtgccttgaataaagtagaggctcagtaaacatttgaggaatggatggatgttactcttttggggctggccagatttctttctttagttctgttcttttctgttctattctgttcttttccttttcttttctttctctctctctttctttctttttctttgagtttctttcttgttgcccaggctggagtgcaatggggtgatcttggctcactgcaacctccgcctcctgggttcaagtgattctcctgcctcagcctctcaagtaactggggttacaggcatgtgccaccacacctggctaattttgtatttgtagtagagtcggggtttctccatgtttgctaggctggtctcgaactcccgacctcaggtgatccgcccgcctcggcctcccaaagtgctgggactacaggcgggagccactgcgcctggcctggggctggccagatttctcgggaaaatttgcctgtcttttttttggaggcgaagacctagctgccctaccaggtctacaaaccaagtggtggctgagagttggtcatctcccaggttccccctggtgctgcctagctcagttcttctgcagctccctgccatgcttgtagtggacatcgcagtcgcacttcttagtttaaagcatccacctaatgcagttgtgtgtgtgttatgctgaacgttgaggatgtgttttgaggaatgcatcgttaagtgatttcgttgtgggggcatcagggagtacatttacacaaacctaggaagtataacctactgcacacctaggctgtatggtgtagcccattgctcctaggctaaaaacccatacagtatgtggctgtggtaggcagctgtaacagtggtaaatatttgtgcaactaaacatatctaaacatagaaaagatatagtcaaaataggtgttacaatcctttttttttttttgagacagagtctcgctctgttgcccaggctggagtgcagtggcacaatctcagctcactgcaagttccgccttctgggttcatgccattcttctgcctcagcctcccgagtagctgggactacaggcacccgccaccatgcccagctaatttttttgtatttttagtagagacagggtttcatcgtgttagccaggatggtcttgatctcctgacatcgtgatccaccagcctcagcctcccaaagtgctgggattacgggcatgagccaccatgcctggcctggtgttataatcttatgggaccactgtcaaatatgaggtccctcattgaccaaaatgtcattatactgcacatgactgtattgtacagaatttgtctattgtaaatttgttagtttgcgtcatatctatcagggagttagttaaaattcccaaggccttctcttttagtcattagtgtgacagagtaagtaaaatatcactcctgtcataaaggacgaattaaaaggacagttttagtgtgtaatgagaactattttctgagacagtcttgcttgctctgtcacctacgctggagtgcagtggcatgatcatagctcacgcagccttgaactcctgggctcaagccatcttcccacttcagcctctcaagtagttgggagtacaggcacatactaccatgcccatctaatttttaattttttaattaaaatattatatgtatgcatatatatgtgtatatatacatatttcagacaaggtctcactctgtcacccaggctgaagtgcagtggcacagtcatggctcactgcagccgtgaactgcagacatgcatctttatgcctagctaattttttttctttcttttttttctttttgaaaagatgggacccctctatgttgcccagtctggtcttgaacccctgggctcaaacgatgtttctgcttcagcctcccaagtagctgggagtacaagcatgtgccaccatgcctagctaattttttttgtttttttgtagagatggggtcttgctgtcttgcctaggctggtcttgaattcctgggttcaagggatcctcccacctcatcctcccaaagtgctggggttacacacatcagccacagtgtccagcataagaactatttctatttttcatattacctctgcttggattactttagaggtaaagcaactgaatatacaaattcatatttatgtctggtgtttttgtcagagctgagtggtagaactttcgttgtagtctgtatattaggttttattgcatgccatctcttttcagttacacgggtacaaatccttacctgtcaagtaggatgttgaataatacaaacatgctacagttaccttgtctatccgaactgttaagccttatttcaagtttgagcatgggttttttatttactttctttatccagaaactttttttttatttttatttttttgagacggagtgttgctctgtcacccaggctggagtgcagtggcaggatctcggcttactgcaacctccactttccaggttcaagcgattctcctgcctcagcctcctgagtagctgagactacaggtgtgtgccaccacacccagctaatttttgtatttttttttttactagagatggggttttgccatgttgaccaggctggtcttgaactcctgacctcaagtaatccgcctgcctgggcctcccaaagtggtgggattacagggagagccactgtgccttacccagaaacttttttgttattgtttcttatatttccaaaaggcaggtaagccttttgaaaggatggcatggccaggcatggtggctcacgcctgtaatcccaacactttgggaagccaaggtgggcagatcccaaggtcaagagatcaagaccatcctggcatacatggtaaaaccccatctctactaaaaatacaaaaattagctgagcatggtggtgtgttcctgtagttctagctacttgggaggctgaggcaggagaatcgcttgaacctgggaggtggaggttgcattgagccgagattgtgcaactgcactccagcctggcgacagagcaagactccatctcaaaaaaaaaaaaaaagaatagcatttcctaatttctgtcccagtgggtagtttgtaaaagaccaggtctatttgtattgggtttttttttcttttgagacggagtctcgctcttttggcaggctggagtgcagtggcgcgatctcggctcactgcaacctctgcctcccagattcaagcaattcttctgcctcaagctcccgagtagctgggactacaggtgcacgccaccacgcctggctaatttttgtatttttattagagacggggtttcaccatgttggccaggatggtctcaatctcttgacctcgtgatttgcctgccttggcctcccaaagtgctgggattacaggcgtgagccaccgcgcccagcctgtattgtttttcaaatgacattttaaaaagagtaaaaattgttttatttctaggttacaaaatgctacagacaggattttaacatttattttgatttattttttactcctggcaagttgcgatacaggtatttaatcagaggtcccaatgtggagcctgacaggataggttcttaacattctcaatttatgtcctcagaatgtggtagtacgaaagaatgattgaagtaaatctttggacttgagacttgtggcctggcatggtggctcatgcctgtaatcgcagcactttcggagggtgaagtggacaggtcacttgagcctaggagttgaaggccagcctcggcaacatggcaagaccctctctacagaaaataaaaagaaaataaaaaagaaagaaaaattagccaggcttggcggcacgcacctgtagtcccaactacgtgggagactgaggtgggaggatcacttgagcccaggaggtggaggttgtaatgagccaagatcatgccactgcacttcagcctgggtgacagagtgagaccctgtctcagacaaaaaaggagaatcatgtatgttaaaaatacatgtcaaaatggcacagtgggctgggtgcagtggctcatgcctgtaatcccagttctttgggaggccgaggcgggcagatcacctgagctcaggagtttgagaccagcctgggcaacatggcgaaactgtgtctctactaaaaatacaaaagttagctgggtatggtggtgcatgcctgtagtcccagctacttgggaggctgatgtgggaggatcgcttgagcccgggatgcggaagttgcagtgagccaaaatagtgccattgcagcccaccctgggtgatagaatgagagcctgtcttaaaaaaaaacaaagaaacagtacagtgacaattgcctatactcctagctccttgggagactgaaggtggggaattgcttgagtctaggagtgcaagtccagcctgggcaacatagcaagaccccatctctaaaagaaagagaaaaacatgaaaaccacaatactatataattgcaaaagttgagtcactatctaaaataatgtaaacaaaatgagttctaaaataaaaataacaattatagggtttttttggtcttcattatgttaggtagtgacttacagtctgtagacacagtacataatttgttaggggcctggtgtgatagctcatacccatatctccagcactttgggaggccaaggtgggaggatcactggagcccaagagttttagaccagcctgggcaacatggtgagacctcatctcaaaaaaaaaaaaaaaaaaaaaagaatttgttaggtttacttgaatcctgagactttaaatttagtagactgtaatagctttgcctgttgaacaatagccttaaagaggtttgaccctaaaaagggcttcttatgtgttttttttttttttcgagacggagtctcgctctgtcgcccaggctggagtgcagtggcgccatctcggctcactgcaagcttcgtctcccgggttcacgccattctcctgcctcagcctccggagtagctgggactacaggcgcccaccatcgcgcccggctaattttttgtatttttagtagagacggggtttcaccgtgttagccagggtggtctcgatctcctgacctcgtgatccgcccgcctccacctcccaaagtgctgggattacaggcgtgagccaccgtgcccggcagcttcttgtgttttgggagcttaattcagatgttagatttatcaggttttacactggagattttgcattgagttcttttggtctcacggagtaaataatggaactttaaataggactttttttttttaaggaataaaagcataataaaaaaagttcatagttagaataacctggggccagatagcttgtgtgtcagtcagagggaaagagggaagggagtatttctgagcctgtactattgttccaggtcaggtgggtatcaatttcacttgacgtacagggagactgagcctccaccacaccccagggtaggtgagaagaagatgcattagctccaaagctgcttcattcattcattgcacacatctttattgcatgcccgtgggttgctaggcattgttttggctgattccttgttccattgaatcatctccaggcatacacggcatgagagttggaagatggtccagtgatggtgtgatttataggctggcaaaatgtttgagtcaacttagatactgagtaatttttaccttgcagaaatcagtaaatcagtgttacctgttacttagcggtagcctgtatactttttttttttttttttgagatggagtctcactcttgcccaggctggagtgcagtggtgcgatctcagctcactgcaacctctgcctaccgggttcaagcgattcttctacctcaacctcccgagtagctgggattgcaggcacctgccaccacgcctggctaattttttgtatttttagtagagacggggtttcaccatgttggccaggcttgtctggaactcctgacctaagtgatctgcttacctgggcctcccaaagtgctgggattacaggcgtgaaccaccaagcccagccgcctgtatacttttgaattcttcatcttgaggagctgcaagatagttttccctcagaaacgcattttgtttctgcatcaaacttgaaaaatgtcctaagtagacttgtcagtcgtttacagttttataccttatttatttatttatttagtgatggagtcttgctctgtcgcccaggctggagtgcagtggtgagatctccgctcactgcaacctccacctcctgagttcaagtgattctcctgcctcagcctccataatagctgggattacaggtgtgcaccaccacgcccggctaattttttgtatttttagtagaaacgggtttcaccatgttggccaggctggtcttgaactcttgacctcgtgatccgccagcctcggcctcccagagtgctaggattacaggcgtcggccaccgcgcccagcttgccattacttttattcatagaatgatctttagtttgacctacgtgcatatagacttttgcctgtatttccttctagtttcttggtttttttttaatttagttattaatctggaattcatgttagtatatagtgagtgtaggagtttaactttattttatttttcctaaatagccagttgccttggcaccgtttattatataagctgtctttggttataatggcttagcctagaaatggtgagaggtatcgagtctaaatatacatgccgctgtctgtttccctctgaagaagtggcacgtgtacttaacatctataccatggtcacctggggggcaggtttcttgtgctctcactccgtgctgctcctctagccttggtactgggtctggctttgcagtgatgagcagctgctcaccagcagtgggtgccgtcacacctctgcctcagctcccctttgctgccgggctggcagtgcccttagcaatcttagtagcccttactagccttgagaggtgctacttgataacactggcttcccttgggagtggtttcttctgtctggccttcgtctctcagttggccattgccccccaccaccgtgttccgccacacagccactgtccctgagccttcaggtctttgtgcacctgcttgtgtagcttgtcttctgctagcttgcatgtccccaagggcgaggcccttattaatctgtacattccagggcttagctcagagtaagttttagtaaaacacttgcatctgctagtttgggaaacataaaagaatatatgttgcatcatttggatataatacataaatactttgctgtcagggtggaaaaacaggccttaagttttattttcctcctcctgaagacccttcccttcagtcataggaacctcaaagatgttcagatcaacactttaacctagtacattttaatcttgtttgttgaaaactggtccttaagtgttttctttcactcattttacaaatgtgtattgagtgccaggccggggatatatcatggaacagtatggatgaggtccctagtggagcagcagtatcactcagcaatatattcccagcctggcacaccatggatttgctacagtgaagctggagagccctgtgttaaataaatactaacagttaacatactgtcaggtagaggagtggcctttgttcttttttttttttgagacagaatcttcctctgttgcccaggctggagtgcagtggcgcgatctcggctcactgcaactcctgcctcctggcttcaagcgattctcctgcctcagcctcctgagtagctgggagtacaggcgagcgccatcaggctcggctgatttttgtatttttagtagagacgggggtttcaccatattggccaggctggtctcgaactcttgacctcgtgatctgcccgccttcgcctcccaaagtgctgggattacaggcatgagccaccgtgcccggtcggcgtttgttgttttgttgttttctggcctctttgttagtggagtggaggtggatttctgaatagtcttacagacaacttccaaattttaaaaggaattcagtcttcatatgtatggaaaaagaaaatcatttttccagtgtgtgatgcagagactaacgtgaccctattctcaagcactcatagcttcaccccaaaatcctggaatatatagtctgtatctgctgattcagcttttcttcccttcatgcagcgtctgtcagtccatccattcactacatggactttctgggccaggagctgcctctagaagctgtggagtcctacaagatcaagtccctgccttttttctttttttgggaattttttaaagagacagggtcttgctccgtcacccaggctagagtgcagaggtaccatcatagctgactgtcacctcaaattcctggactcaagcgatccttgtgcctcactgagcctcctgggtagcaaggaatacctgcacataccacccagctaattttacttcatttatttttatttatttatttaggcagagtctcgctctgtcacccaggctggagtgcagtagtgagatcttggctcactgcaacctctgcctcccgggctcaagtgattctcgtgcctcagccccctgagtagctgggaccacaggcgtgtgccagcacactcacctaatttttgtatttttagttgagacagggtttcgccgtgttggccggctggttttgaactcctgccatcaagtgatccgcctgccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctggccctggtggtgcttcgctgtgccatcctcatctgtgagcctgcccggtgaccgtgctgcacctgtccttgatgccctgtgtcttccaggtctgctcctcccctgctgctcttcctgttccatgttctttggctggtttttctttcttcttccagctgtgtgactccttttcaagcctttgtccagttaaacattttaccaagaatgtagtgttcttcctgcatttcattaggaagagaaaaaggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgtattgattgattgattgagatggagttttgctcttgctgcccaggctggagtgcagtgatgcagtctcggctcactgcatcctctgcctcctgggctcaaatgattctcctgcctcagcctcccaagtagctgggattacaggcatgggccaccacacctggctaattttgtatttttagtagagacagggtttctccatgttggttaggctggtcttgaactcccaacctcacgtgatccacctgcctcagcaaagtgttgggattacaggcgcgagccaccatgcccggcctctgaattttatttttatttttatttttttgagacagtgtttgctctcgccgcccaggctggagtgcaatggctcaatctcagatcactgcaacctctgtcccccgggttcaagtgattctcctgcctcagcctcccaagtagctgggattacaggcacataccaccattcctggctaattttttgtatttttagtagaaactaaaatgttggccaggctggtcttgaactcctgacctcagggcctctctgaattttgaaaagcggatccaaaatagtggatactgctgtgtatcatttaggatttgatttggctgccagtatcaaaaaaacaaaaacagtggcttaaaccacaagatgtttgtcaaataagtactgaggtacactctcctggacgggttctgtagctacacagtcatcggggatactcaggttcctaacatctgccacactgcaccttggcagcctgtcttggggactgagagtgagctccatgtggccctgttctagcataggggaagggaaaggaaggacgtgcctccttccttgaaggctgctgctttgatgatgtgtacagcagtgcttacattgcattggccagaccttatggctgtacctgggtgagtgggagactggggaatgttgtcttcccacttacagtggcaggtccttaagcctaaggaaggagaatggacactggccagtgggtgatggtctctgcaatcccagggccagattgcttcatatctttgactaacctttgtttctataatatcatgcttgacatagagatgaaaacactggaaacatctaggtttttaaatactctctcctgataacttctggctctgtcagcatatcttaggtaaaattaaatataccaaagctttgcttctttcttagcattctctagtttagtgagtgaatagagcagaagaggggctgctggccagcggtttctgctttcatagaggaagtgactgcccacaccctgattttagagtcttcatcctaaccatgttacagccttgagttgcagaactgtagctctgtttggatattgtgaacgtattatttctcaagttctgttaccttgagaacaggtgacatgaatttaaacttgcttttttggtgtcgcagataagagttttaaaaaaagaaggaagaaaaggtcccaccttctggagtttcaggttttaaacctaggaggataataacctggttattatgttatgagagggatgggcagatgtatgttctaaagagagaacagattgctgccagccagctcctagctgtttgtgctcttatgctcctaggaacttgccacagcctcacgctggtctgttccagaaaccagtgagcactctgtaggcagagccctggagtggcccctggattttatgacataaacataagcttatgagtgcaccagtgcattcttactcttggtggtagctacagagatgtcttctctcaccttggaacatcaaggaagatttgtatgtgcactgttctctgacccccacttgcagcccttcaccaacatgcactctgtgcgcagacatgcatgtgtgtacacgaggtcttacacatgggaaagggtctataaaaaattatgttgggcccatcttgatagaaagtaaaataatacagtttcatcagaagggtagctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttttttacaaggagtctcgctctgtcactcaggctggagtgcaatggcacaatcttggcttactgcaacctccatctcccgggttcatgtgattctcctgcctcagcctctggagtagctgggattacaggtgtgtgacaccatgcccagctaagttttttttttttttttttttttttttagtagagatgaggtttcactgttttggccaggctggtcttgaactcctggcctcaagtgatctgcccacctcagcctcccaaagtgctggtattccaggtgggagccaccatgcccagccttctttctctgttggctctatttggatgtttatcctagtctcagttatttttcattcaacatttatttctgattcagttaactttttttttttttttttttgagatggagtctcactctgtcacccaggctggagtgcagtggcacgatcttggctcactgcaacctccacctcccgggctccagcgattctcctgcctcagcctcccgagtagctgggactacaggtgtgtgccaccacgcctggccaattttttgtatttttagtagagatagggtttcattgcgttagccaggatggtcttgatctcctgaccttgtgatctgcctgcctcggcctcccaaagtgctgggattacaggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatcccatcatgagggccccacactttcgagctcatcttatcctgatcacctcccaaaggtttcatctctaaataccattacactgggggttagggctttaacataggaatttggggagaacacagtttagttgacagcatgctatttcaaaaggcttaccaaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctcaaaaaagaaaaaaaaaaaaaaaattaaggccgatgcggtggctcatgcctgtaatcccaacattttgggaggctgaagcgggtggattacctgaggccaggagttcaagaccagcctggccaacatagcaaaaccccttctctattaaaaaatacaaaaaaattagctgggtgtggtagagtgcacctgtggtcccagctacttgggaggctgaggcatggaattgtttgaacctgggagttggaggttgcagtgagccaagatcatgccgctgtactccagcttgggtggcagagggagaccctgtctcagaaaaacaagcaataaataaataaataaataaataaataaaagatgcttgctctagagtgctatggaaatgcaagtactttgcagatgtcgatgccagcagtgattgacctgggacattggaggatgttgagaagaagaaaactggtttcgtaggatcggagacttttaaaatttattattttgaaaaagtgttaaacttggagaaaacatccagtgagctggctctccttaccctttccagagtacttacgagtgcctgtttcttctgaaacctgttcacatagtggcatagcatgtgccacggctgcttactgctgctgggcgtctttccctagggtgaggggttctcctgtggcagtccagggccaagggcactcaggaaattgcacacagacccagtatgtcctctcctctgcagctcatactctccttttgttaactgccaacagcatccttcatggcattgtttcactgtgtcccagggtccagttcaggggtacatcctgcatgtggccgtcacatctgttgagtagcctttcacgtggaatggggtctctgtctctggttgtctttcatgacattggtgtttttgaagaatgcaggccagttattttgtccatcattcctcagttggggttcgtctaatgcctggattatgcatcccagacaggaatattctaaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctcggtgcagtccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacaggctagtcacttttgtttacctactgaattttacctagagacaatgtttttaaccatcttgccccttaaaatatatttttatgtatctgtataaactatttttcaaccatatccacttctctttaaacaggggttaaattaaaaatatttagcaagcttttttttttttttgagacggagtctcgttctgtcacccaggctggagtgccggggtgtgatctcggttcactgcaagctccgcctcccgggttcacgccattctcctgcctcagcctcccgagtagctgggacttcaggcacccgccaccatgcctggctaatttttttgtatttttagtaaagacggggtttcatcgtgttaaccaggatggtctcgatctcctgacctcgtgatccgcccgcctcagcctcccaaaacgctgggattacaggcgtgagccaccgcgcccggcctatttagcaagctttgtggaagggtgtcactgaatcagaagaacagatgctgcccgtgaccactcagttcagcttgtttagaatagaccacagtgtacccctaacgccagccaaacgaagctgttttgaccttttccacaagaccctgtgcaggcggcttcttttgtctaaatagccttcccacttggcctggcggtgtcttcctgccttctgaggcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcctcaccttcctgagtagctgggaccacaggcatgcaccactacacccagctaaattttatatatttcatagagacagcgttttgccatgttgcccaggctggtctcgaactcctgggcttaagtgatctgctcagctcggtaccccatagtgctaggattacaggcgtgaaccactgcacttggccaaggcttttttttttttttttttttttttaaacttatatgcccattaaaacatatggaagtttctggacagcactggatattattaatataaatgagttaagtaagcataactaggtttttgttgtgcacagcgtgcatgggcacacacatcactgctgggtgctggggatgccatggcctctgtcagtcttgtgtttttccctagcattatagtgtgagagttgacccacgtgcgtagatgtttgggaaaaaaatagtagctacatatgtattcatattcagtattctacctttcagcttgttatttcatcattcttgtattaagggacacataattttaagctttttttttttgcctttaatattttactgatctttataaggtttgttcaagattttggattgattgattggttgtagagatggagtctcaccatgttgctcaggctggtctcaaactcctgggctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttgggaccacaccggagaaccactgctaactaatagtcccagacattttataatatgtcatcgtttacagaagtgtttaatatacctcatctcatttaattcttttttttttttttctgaaacgaagtcttgctcttgtacccctggctggagtgcaatggtgtgatctcagctcactgcaacctctgcctcccgggttgaggcgattccacccaccccggcctcccaaagtgctgggattacaggcgtgagccaccgtgcctggccattttttttctttctttttttttttttttttgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtggcacgatctctgctcactgcaagctccacctcccaggttcacgccattctcctgcctcagcctcccgagtagctgggactaaagccgcctgctaccacacccggctaatttttttgtatttttagtagcgatggggtttcaccatgttagccaggatggtctcgatctcctgacctcgtgatctgcccgcctcagcctcccaaagtgctgagattacaggcatgagccactgcacccggccctgtggtttttcttaaatagtttaagcttaacttttatttctgtagttgaaaattacatttaaaaaagctgtagtgaggccgggcacgatggctcatgcctgtaaccccagcactttgggaggcctaggcgggtggatcatgaggtcaggagtttgagaccaccctggccaacatggtgaaatcccgtctctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttgagatggagtctcgttctgtcaccgggctggagtgcggtggcgtgatctcggctcactgcaacccccacctccatggttcaggtgattcttctgcctcggccttccaagtagctgggactacagggacacaccaccacgtccacctaatttttgtatttgtagtagagatggggtttcaccatgttggccaggatgttctcaatctcttgacctcctgatccgcccgccttggcctcccaaagtgctgggattacaggctgagccactgtgcccggcgctgttttttgtgtttttaaaaatttttcggttttaggttttgagaaataaccactgtgatgtgtttttaactgactattagctgaaaacaactcatttaattagagaatagcccacaaaacaaagccagattggcccatacaaatcagtgtttaagactcaattacaggctgggtgcagtggctcatgcttgtaatcccagcactttgggaggccaaggtgggaggatcacttgagcctaggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaacatgattaaagataaattcaccaaatatgctttatgaagctgaaaaatgaaataattattattataactaaagattaactcagagctatagattaagtcaatgtcatatatatttaataccagctgctacagttcatggtaattaggtattaaaaaatataacaacttgttcatttcagcagtgctgtgtatgacaatctctttagatgttatgaagattcgggtattgggtctatccgatgagtgaccacaaattgtgtttttttttttctgaaacggagtcttgctgtgtcgcccaggctggagtgcagtggcacgatctcggctcactgcagccttcgcctcctggattccaggaattctcttgcctcagcctcctgggtagctgggattacaggcatgtgccacaacacccggctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggctaggagaagagcatcctgggcaactgggacagctgtgggctcttcagaagctggcagtaaaactcacatagcctttacaaagcccatttccttatcttcaaaatgtgcctaatgtgtacatttgtacatagtacaaccaatgtacaaaaatataactaccatgaaggattactacagtaattaacacagctaaagaagatgagcacagttccctccctcccctcatgaataagaatttgagaaattctggttattttattactacgtggtgtagcgagccagttaaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaaaaaagacaccacagactaagtgacttgtgtgaggccccgtagctgagaagcagttagactgggattacagtgcccagagcccataacatgtcctcattgcagagacctatacagttcacgcagaaatggagacaggagcatcacccaaatccatcttcatgtcctcattgcagagacctacccaattcatgcagaaatggaaacaggagaatcacccaaattcatcttttcacatttttaatgtctttccttccttctgtgcctttggtttacagatttcaaaccataccgtccatatcatcatgtatactgcttattttctttacatttttagtgtgagtacctttcagtcataaaaatattttcataaacattacttttaaggtggctttttcctccatagcatgggtctgttggttgtctagaaacttgcgtgagtgttccgagaagatgacttaaaacgaatattgattcgtatgcttgttttcttttttttttttgaggtggaatttcgttcttgttgcccaggctggagtgcaatgatgtgatcttggctcactgcaacctctgcctcctggattcaagtgattctcctacctcagcctcccgagtagctgggattacaggcacacaccaccacgcccggctaatttttgtatttgtagtagagacagattttcaccatgttggccagactggtcttgaactcctgacctcaggtgatcctcctgcctaagtcccccaaagtgctgggattacaggtgtgagccactgcacccggccttgatttgtatcttttctacttttgctagcaacatcttgctactttttcttagactattgtttaatgtttttgtttagtgctcacattctgaatactcccttgtgctacttgagcagctggcattttagaaattacattccagggccctagcatttgctggggtgtcttgacagttgctcacctgtctcaggacattgattctgtaccctgtgtcttacctgttgcttggtgtccagctctgtcgtccatagactttttcctccagtgtgaacctaatctgtccatgctgtaagaagtagtatctaacaaggatcatataaaaaagaaaacaggctgggcgcggtggctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgctggagacacagatccacacacactccttttcctcacagcccatggggccttgtcctctgcagagggaagtgtaggcccctccgtggccggcccgagagccttgcctcttgagcccgagcctgtgcagactgccctctgtgatggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaattttacagtttcagaaaagtacaagagaaagttaaaatatattcaagccaaaacagaagtctgttagttctttagattatgtgctgttgatagtggttgttcagagcttatatgtcatagttctgtatgtcatgtgctttcttacagtccaactgttacaaccactctaaaaaaccttggggcactttacagacgtcaaggcaaatttgaagctgcagaaacgttagaagaagctgctatgaggtctcgtaaacaggttagtcatacttctgtccttaaccggcccatgggaactttgaattgaatgcttctcttttacatgaattttattgaaagcttgatttagaaatagaaaatgttgattattttagtttgaacaaataaagttatattgtttaaaagagcatgaggccgggcgtggtggttcacacctttaatcccagcactttgggaggccagcgtgggcagatcacctgaggtcaggagttcaagaccagcctggccaacatggtgaaaccccgtctctactaaaaatacaaaaattagctgggcgtggtggcacacgcctgtaatcctgtaatcccagctactcgggaggctgagacaggagaatcgcttgaacctgggaggtggaggctgcagtgagccgatatcatgccactgcactccaacctgggtgacagaacgagactccgtctcaatttaaaaaaaaaaaaaaaagcatgaggctgggcacagtggctcacacttgaatcccagcactttgggaggccaaggtgggtagattgcctgaggtcaggagttcgagaccagcctggctagcatggaaaaaccccatctctactaaaaacacagtgcagtggcacaagcctgtagtcccagctactggggaggctgaggcaggagagtcgcttgaactcaggaggcagaggttgcagtgagccgagattgcactactgcactccagcctgggcaacagagcgagactccgtctcaaaaattaaaataaaataaaataaaatagcatgaatatgaccccaaaagcatgaacagcaaaataaaaactagatctgttggattcaccaaagttaaaagctcttgtgcatctaaggacatcatcaagaaagtgaaaggggactgggtgtggtgctgagcacctgcaattcctgcacgttgggaggctgaggtgggaggatcccttgagctcaggagttggaaaccagcctgggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaagaaaaaaaaaaagaaaaagtgaaaagacccccatgcaacaggggaagatatttgcaaatgatgtatctcataaggttttggtatccagacaaaaagacaacccagttaaaaaatgagcaaaggacctgaatacacattttactgaagatgatatacagatagccaacaatcacatgaaaagatactcaacatctttagtcattatagaaatattaactgaaatcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccgagacaagaatcttgctctctcgcccaggctggagtgcagtcacgctatctcggctcactgcaacctctgcctcctggttcaagcaattctcctgcctcagcctcctgaggagctgggattacaggtgtgcgccaccacacctggctaatttttttatttttagtagagacagggtttcaccatgttggccaggctggtctctaactcctgacctcgtgatctgcccgcctcggcctcccaaagtgctgggattacaggcataaaccaccgacttttcttattttttaaatggtagggcagtatgcacataggtattaatttttaatcaacttttttgagggataattagagacagtaaaaggggcccattttaactgttgtctgatttaaatattaacacggttcaggtcagcacattagtttgtctttatatagatgttagaacaaagtttctcatgctgtttctgtttaagtgaaaatttccctgagattgcaaagcaaaccgttaccactgtagccacttacttgtgtgcatcaagatttttttcagtattatgcaattaagttaaaatagagacataggtgttgaggtaaatgttaagactataccttgccgggcgcggtggctcacacctgtaatcccagcactttgtgaagctgaggcgggcagatcacgaggtcaggagatcgagactatcctggccaacacggtgaaaccccctctctactaaaaatataaaaaattagccgtgcatggttgcgggcgcctgtagtcccagctactcaggaggctgaggcaggagaatgatgtgaacccgggaggcggaccttgccgtgagccaagatcacgtcactgcactccagcctgggtgacagagcaagactctgtctcaaaaagaaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttgaaacctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatctctctcagtatccctgataacctaagcccttagaactgttgccatacacggccagggtgcggggtggccagagatggcccagtcccttagtggtagggctcaccctcttgtccgcttggtatccctgtgggagtctctgtcgtggatggagacttctcttcatggctgtgagagaggtgcaggcctgaggcaagaggagtgacgtggcttttgtaaggagcttctcacaactgttttccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggggaaatggattttaaattgcctttggaatagtgatcttattttaaaatgtttacagatttccagaaccaaaatgatagattactatctgcctctcgatgaattttgagattacacatttcttcttaaacagcattgagagggttggagcagtgctgtgtgactgcttggtgtcgcttccttggaatgatgtgaggtgtcacacagcagctctcagatcccctccaggaattacatgatgcccagagagagcattctggacattatttaattcctggaggggatcacactgattgtttgaggttcttaagttttgaagccttttaagtgcagagtccagttctggtgctgagtgttgtaacttggaccacactcccacatgacagctctcagagttgttctgttttctcgtgttttgtgtctttgccgtgataaaaatgtagcagtgtgtgaccagtccccagtgttagaactgtggtcagtgttcatggggctgtagcactgccagcctgaaccatgtgacatagatgcacacacttgcacggactaacgttttctacatgactttggaaattgcatcccgtaaaatgcatacaactgaataatctttccaaataagagtgactgtttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcgtgatctcagctcactgcaacctctgtctcctgggttcaaatgattttcctgcctcagcctcccaagtagctggaattacaggcacatgccaccatgcccagctaattttttgtattttagtagagatggggtttcaccgtgttgctcaggctggtctcaaactcctgagctcaggcagtctgcccgcctcagcctcccaaagattacaggtgtgagccactgcagctggtcttttttttgtttcgttttgttttaaagagagacagggtcttgctctgtctcccaggctggagtgcagtggtgcagtcatggctcactgcagccttgaccacctgggctcaagtgatcctccacttctgcctcctgagcagctgggactacagatgcatgccaccacgcctggctaatttttgtatttttgtagagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcactttttttttttttttttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgcttta

SEQ ID NO: 1300 - DNA, 72365 bp, Homo sapiens; identical to SEQ ID NO: 1299

SEQ ID NO: 1301 - DNA, 10330 bp, Homo sapiens
accctcgctctcagcggcggccaggtgcgtgcgcgtccgcgctcccggcggcgggggaggggcggacgcgcagtgggcaccggtggcctcccccgcccttgcgtgagccccgactagggaagaccgcggacggtgggaggactgaggcccgacagggaagggccggcccgggtcccgcagcggatcacggcagggccgggactcgaacccgggctcccgggggccgactgtgggccgggagcgtccctgcggcgacggcgcgcgcccgcactctgaccgcggcctgacccccggctgccggcgcgccgtggggctgcggcccagaggccagtgggaggggcgcggggggcccccggagcgagcatgtgacccgaggccgcgcgctcggaaccagccccggcccgacgcccttggctggcacctgcttctcccccaccggcgtcttccgcggctctcggggccgcgccccccgcaccagctcccgagccttggccttcgcccgagcgatctcccgcctagaaccccgcgcccacctgtgccacctgtgcccacctgcgccagcatccctcgaggtccagctccagcgtccccggggagggtccggtcctcgtctccagggcctgggtctctccctgcagtcccgtctccagaggcgccgccccctcgggcctgagcgccggagtgacagagccctgggcagggccctgagcagaccctcagtaaaggctgccaggggggtaggcacccgctcggggccccccacatggtgccattcgcccggaccgcggcggagagcagacagggggactgaggtgctccccgcggcagcaccgaactcccacgggcatcagaaggcaaggtctgcggatggccccagacacagaaggcgtaagccgccctgggaagcgccggcccagtggagaaggccgccgcgaggtcagggtcagtctggagcctgtctggttctcggagaggcttctggctgctgcagagtgggggcagagcaagggaggaggccagggagctcccaccagcccattcctggggagccacccctgtccctcagaggccacgggggctcgtgtttgcgagtgtggactttccagttagacagacttggttcagcaccgcctccgccacaccctcgcctgggatcctaaacaagccgcatcttctctgcatcgtagtgtgcttgtctctgtgatgggagagtgtagggataatagtgcctgcctcgtgtcaagaggctttttcggatgcgagggatggaaagcgcccagcacaatttgtggcacgtggtagctgttccataaatagcattctgtagttgggccgtgattagcaaggaggcttagtgtacagacgtccctgggatttttaaacctatccacacctgggcatgaatggctaatgacacccctcttctgggagcagagtttggagagaagaggaggctctagataatgagtgatcctaggctgaaagtcagagacatacttaagttctaattctagctgctctgcttctgacctcctgtggggccttaggcaacttgcactccttctctgggccttggtttccccagctttgacagctgatgtccctgagtcacgaaggggtacttctggcccacgaagcctgacaaaggacaggttttgccaaggctcttcagagaggtgccccccggggtaaggtgatccaaatgagcctgctcttccaggaagggaagcattggcacaagggctcccctcttgcctgcaggacctgtgggcacagacagtggcagctaccgtgcctcacaccaaagcatcctatatcctccaggtaagggtccatttgaggcaggctggtcagctccccctcaagtccttcccgctggtccccatcctcctctccacccagcctgccacctccaggcatcggcccatcacctcccacctggaccaagctcattcattataagcccactgctctagcctccacgcccccaccattcccaacacgcccctgccctccatcttcctggagcacacacggcccaaccctgtaaagcccttctgtgtctctccattacacagaccaaagttcacgagcagcccatcaggaatcgccgtgaatgttgttaatgtgcagtggctcacgcctgtaattctaccactttggggggccaagatgggaggattgcttgaggccaggccaggagttcgagaccggcctggtcaacacaatgagatccccccatctctaaaaaaaaaaaaaaaaaaaaaggaatcaccagtaatgatgggatataggcattaaggttacggaagaagatgtccatattttttagagatgcatcctagcatatgtaaggggtctgcaatttgtttaaaaacaattcagccagagggaaagagagccaagcaattaggaataactgaaacatacgtggcaaattcttgataacatttgaacctggatggtgggtatgttggggtgcattgtactttatactctatgtttgaaatattttatgttaaaaatgattaaaggggccgggcgcggtggctcacacctgtactcccagcactttgggaggccgaggcgggtggatcacgaggtcaagagatcaagaccatcctggccaacatggtgaaaccctgtctctactaaaaatacaaaaattaaccggccgtggtggcgagtgcctgtagtcccaactacttgggaggctgaggcaggagaatcacttgaacccggcaggcagagattgcagtgagccgagattgtgccactgcactccagcccggcaacagagtgagactccgtctcaaaaaaaaaaaaatgattaaaggggctgggcacggtggctctgcttgaaatcccagcactttgggaggccaaggtgggtggatcacttgaggtcaagagttcaagaccaaccttgccaacacggtgaaaccccgtctctactaaaatacaaaattaactaggcgtggtggcatacgcctgtaatcccagctactcgggaggctgaggctggagaatcacttaacccaggaggcagaggttgcagtgagccgagattgcggcactgcactccagcctgggagacagagcaagactccatctcaaaataaataaataaataaataaataaataaaagcaaggcatggtggtgctcacttgtagtcccggctcctcaggaggctgaggcaacaggttcacttgagcccgggagatggaagctgcagtgagccaagatcacgccactgcactctagcctgggcaacatagaccctgcctcaggaaaaaaaaaaataaagattaaaggctgtagattaaaggctgggcatggctgggcatggtggcttaagcctgtgatcccagcacttgggaggccaaggcgggcggatcacctgaggtaaggagtttgagatcagcctagccaacatgctgaaaccctgtctgtaccgaaaatacaaaaattaggccaggtgcagtggctcacgcctgtaatcccagcactttgggaggctgaggcaggcagattgcttgaggtcaggagttcgagaccagcctgaccaaccagtctctagtaaaatacaaagttagccaggcgtggtggcacacgcctataatcccagctactcgggaggctgaggcaggagaattgcttgaacccgggaggcagaggttgcagtgagctgagatcgcgccactgcactccagtctgggcaacggagtaagactctgtatcaaaaaaaaaaaaaagttatctgagcatgatggtgggcgcctctaattccagcttatcgggacgctgaggcaggagaatctcttgaaccctggaggcggaggttgcagtagttgagtttgccccactgcaccccagccttggtgacagcaagactctgtctcaaaataaaaaaataaaaggctgagcatggtggctcatgcctgtaatcccagcattttgggaggccaagacaggaggattgcttgagcccaggagttcgagaccaacctgggcaacatagcaagacccccccccatctctattttaatttaaaaaaattaaaaatgattaaatactcttaaaacagataaaaagtccctttagggaggacattagtatatattcatattggcataaatacattctggaagaatccagggaacactaataaagtgatgactgcacgtgggaatgggaactgggttgataaggggcagaaatcagagtgaggcttttcactattagtttttgaaaaataaactttatttttagaacagttttatagaaaaattgcaaagagtttgaaatacagagagttcccagatacccctttctccatccagttttccccattttttaacatcttacatcagtacagtacatctgttacaacaaatgaaccattatctatacgttagtatcaactcgggtccatacttttcccagatttccttagtttttagccagtgcctttgtttcaggacatcacgtggcgttcagtcgtcatgtctccttgtctccttagactcctcttggctgtgacagtctcggctttccttgttttttttttttgttgttgttgttttgtttttttgtttttttttttttgagacagaattttgttctcactgcccagactggagtgcaatggcgcgatctcggctcaccgcaacctctgcctcccgggttcaagtgattctcctgcctcagcctcccgagtagctgggactacaggcacccgccgccacgcctggctaacttttgcatttttagtagagacggggtttctccatgttggtcaggttggtctcgaacttccgacctcaggtcatccgcctgcctcagcctcccagtgtgctgggattacaggtgtgagccaccgctcctcgccagctttccttgttttttatggctttgacagttttgagtgcttgtcaggtattttgtagactgtccctcagttgaaatgtatgtgatgtttttctaatgattacactgatgttatgagtttgggggaggaagaccacagaggtacgggaccattctcatccgattgtatcaaggatacatatgatcagcatgacagtgccattgacgctgaccttcatctctaggctgctgttgcatttcatgtttgatttttgaatcaggtgactatattactaaattacaataacatgttttaaaacttgactgggcatggtgcctcatgcctataatcctagcactttcagaggctgggatgggtgccttgcttgagctcaggagttggagaccagcctgggcaacacggcaaaatcccatttctaccaaaaatacaaaaatcagccaggtgtggtggcatgtgcctgtggttccagctacttgggaggctgaggtgggaggattgcttgagcccaaaagtttgagaccagcctgggcaacatggtgagaccccatctctacaaaaaaattttgtgttttttgtttttagtttttttgttttttcagacggagtttcactcttgtcacccaggctggagtgctgtggcacgatcttggctcactgcaacctccacctcttgggctcaagcgactcttctgcctcagcctcctgagtagctgggattataggcatgagccaccacgcccagctaatttttgtatttttagtagagacggggtttcaccatgttggccaggctggtcttgaactcctgacctcaggtgatccacccacctcagcctcccaaagtgctgggattacaggcatgagccaccgccgcctggcctctacaaaaattttaaaaattagctgggcatagtggcaggcggcttcggtcccatcttctcaggaggctgaggtggaaggatctgcttgagcccgggggtcaaggctgcagtgaaccgagataacaccagtgtactcccacctgggtaacagagtgagaccctgtctcaaaaacaaaataaaacaacagcaacaaaaaaaaacatgcctaagacccgtattggtttgctaggcctaccataacaaaataccacagactgggtggcttaaaaaaacagaaatttattttctcacagtttcgtggtagttttctggaagtccaagctccaggtgctgcagggctggactcttccaagacctcttgccttggctggcagatgaccaccctcttgtgggctcctaacatgatcttttgctgtgtgtgcacctgcctggtgtctctcttttcataggtcatagtcacattgcattagggcccagccataggacttcattttacctaattacctgtctgaagaccctacctccaggcccttgtccacccacctccctgtgtacgagaaagcactctgtgtatccctcagaaaggagtgcttcctgttctgttgaaaatcaaagccttcttctgcagcatttccccagatcgcccagggatgacgcatctcaccacattcctccagactgcccagacctgggtcacgcatcacaatctgccaccttggagctgtctatgtacctgttgccccaggggccagcaggctccatgaacaggtgtcgcctggtttcttccatgtacccacccaggtccaggccctggtgacacagccttgagcaaaacagtgaggtccctgtcctcacagagtttgtattccggccaggcaagaagacgatagacaagaacacaaatgctggtaagtgtatttttaacaataagtccaggccgggcgcggtggctcacatctgtaatcccagcactttgggaggctggagtgggaggatcacttgaggacaggagttaaagaccagcctgggaaacataaggagagcctgtctctacagcaaaaatacaaaaagtagtcagacgtggtggagtgctcctgtagtcccagttactttgggaggctgaggtggaaggatcgcttgagcccaggagtctgaggctgcagtgagctgagatcgcaccactacactccagcctgggcaaaagagggagaccctgcctcaaaatagtaataacaacaataataataaagccagataatgtgacagagacagctgcctctgccagggagttgcaggctgcaggagcagggagggggaggagcaggtaaggaaagtgctggaggctatggagggaggtagggtcaggcttcagtttgcgggctgtggcgggtctggattttgttggccctgagggcagagggccttccctctggtgtttccaggggaaactctttctgacagctgatttacagtcttaagcttccggtggaagttggctggccttccgcagcagtggaggaggacgggcccttaggatgaggaaggtagaggaagtggatgtggggaagggcttctatctggggtaagatttgaagggtgggagttgggaggaggaaaggaaggactcaggatggctccaggctttggggctgctgtgcagggcctgcaacctggcacccacagtgccttatccaggcctaagagagggcgctgtgggctctgtgctgacatctgcttggccacgctgtccccaagaaggccacatttcatgactccccttcctgtccagcctgggcctgtggcccactctgggatccatctggcactgcagccaaatgccaggtgttaccgtgcccctcaccccctcagtccttcccccacaacacacacacctccttttttctctggccccaccccaacctgagctgccctcacctctactccaagttagcctccctcccgctggaaaatccgacccaaccactccccactgggacccctcggggcctcccttctgccctgacggtcaagggtagttaaacccctgagggcttgggtttgcggctctccagcctcatgccctcaccatcccccgctccaggccgactcccaccccaccctaggccccgctggcagcccctccccagtgtgggggtggggactctgggacaatgggacgtgcagctcctgttccacccccacagctgcccggggaaacctgttttcacaagtgttggctgtgaaccagtcgtggttccatttgctcctctggggcattaagtaatattttttgttatccaggttagaaaataagttggtgggaaaacacccagcgatctgcttgtttttggtcttttgtttggccgtgggtggcccctgtggcctgtgaggctgcacttgtgtcccccaccagatccccagtgcccagcacacagtagacacctaataaatgtgcatggagggcagactccaccgctgcctccaccaaataaaatacagctggaaacccagcgacatccaccccaggccacagaaaagagtgtccctgccaggagttcccacacaggagtcttggaactcagagagggggtctccggagccaacccacctgttttcattcctgcaacaggcctctgtcacaggatcactgtccaggggtaggggtcgccatgcccagaactcagcaagtgttcagctgactgcagcctcatcttcctgcgaggactcagagcggggcaggcgttctctgaagcccagagaggctttgccacttgcccagggccacagagctacggagcctgtgactggaacccggagccaagtctatggcctccacctggtggccgctgcctccaaaaactcccagctccacaagtcccgccctctgccttggcagggtttgcctggtgtcctacacacactgtactggtctttcagggtctaaacctctctttctcccttccttctggaatctgtctggggcccctgtgaggaagaaaaggctgctgggccaggacacttcatccattcattcattcctgacctttcttgcgtcctccgtgctaggcccgaaggagggtaggagtcttggtccctgcacacagcgagctttccctctggatgttgtgtcaggccacacactttagtcttccgtcttttcttcttcaccaagcatcccaccctaagcgcccgctcactcctgcctttatttcgggttttccctgacattcttctacctaacccactgcttttccccagctctctgcctcttggctgcttccagttcccgccattactcacaacgctgtcacatcagtcagggtcccatagggaaacagatggcttcctcaaattagggaaattccaggaaggcgatttacaaagggggatgcttacagaaggaaggggggaccactaggggagggcaggactctgggaccagcattagggggactctttccaccatcagggctggaaggaagagaaaggggagctctccagcaaagaagaaagtccagaggaggctggcctggagggcagtggcattggtcagaggcaggcccaaagagggaggggatccattcccgcatcgctccctctcctgcctttgacctcccacagggcacctccacatctggctgcagcccatggaggtggccccaaaaggcaaaagcagggtgaaggatggagcatcaatctgggaggacgagagccggacacccagcacaggtgtgcaggaaacttctgcacaaacacctttcttctttgtagggggtttctgtagtatgagacatcaagagaattcctgagccagagccttcctggtttgtaagaacaactgcattttaacagaaccccaaaatacgtatgtcactaccccactgaaggcccttccatagcaccatctatggctgtcatgtaacagccacacctggtggcctcgccggcagtgccccaactctgctcccagcaagccagactgctgtgttctccacagcccctgtggtccgggctgtggctctccaaggcccctctcttccattctaggtggatctgctgacacgtggtctgtccttcaaggcctcctccgatagtgcaaatgtatttccaaataccaccaccttaagggttaggatttcaacacatgaatttggggagagcacattcagtccataacaagcagagcctcatgaatgggattaatgcccttataaaaggggtcttagagagacccctcaccccttctggcatgtgtggacactgtcaaaaggtgctgtcgaccgggtgcggtggctcacgcctgtaatcccagcactttggaaggctgaggcgggcggatcacctgaggtcaagagttcaagaccagcctgaccaacatgacaaaaccccgtctctactaaaaacacaaaaattagccggacgtggtgggcacctgtaatcccagctactcaggaggctgaggcaggagaatcacttgaacccggaagcgaaggttgcagtgagccaaggtcgtgctgctgcaccccagcctagcgacagagcaagactccatctc

SEQ ID NO: 1302 - DNA, 9280 bp, Homo sapiens
ataagtagcaggatcaagtttaataaacgtttattgagcagtagaatacaagtgagtgcctggatcctgatcaccaagtcctgtacaactgaggtaattatttcacaatgatgggtggctcagtgagattctgattgcatgcgctgcatgacaaattatctactcagagtatgcctgacacgccggaggggctgagggggaacacactgaaagcagtaccaggtagcagtgcatctcacagatccatttattcatgccatgaagtaaacggtacttatacaagtgtacagtgacgttccacgctccccatctaacacggcttgctgaaatttacaggcagactgacgttttctttcacatgtactccaagtaaatctggttagtgatgaccaggagcaggcgctgaagcttttgaaagagatgcatatataaatatgatttaagaaggaaggaacaagttggatgtaatttattaaacaagtatcaaaagaagttgatcaacagtccaaaaagataaatgacacctttcaatactattgaaaagtaggattatttctatatgaaacacccagagtgcttaagggttcatgtaatgacagcagacaggcagtggtcacccacagcgcaaagagagaggcagggaaacacctcctcctcaaactcatgtagccagtcctgggtttgtgtaacattcaaatggctacagtttcattgtcactctggcataaatttataaggcgctttctttcaaaatacattaaaggccaggcgcagtggctcacgcctgtaatcccaacactttgggaggccaaggcaggtggatcacctgaggtaggagtttgaaaccagccggccaaccccatctctactaaaaatacaaaaaattagccgggtatggtggcgggcacctgtaatcccagctacttgggaggctaaggcaggagaattgcttgaacctggaaggcggaggttgcagtgagccaagattgtgccactgcactccagcctgggcaacacagcgagactctgtctcaaaaaaaaaaaaacccaaaaaacaaaaccaaaccattaaaaacacatcattacgggtaggctgaggcgggtggatcacaaggtcaggagatccagaccatcctggctatgtgaaaccctatctctactaaaaatacaaaacattagccaggcgtggcggcaggtgcctgtagtcccagctactcagaaggctgaggcaggagaacggcatgaacctgggaggcggagcttgcagtgagctgagatcgcagcactgcagtccagcctgggcgacagagcgaggctccgtctcaaaaaacaataaacaaaataaaacgacatcattagggaacttctaggacagcatgcttgcacagctcacttgtgcttccctattggtgatgatatcgactacctctaattaatccattcctctattactcctggaagttttacttgatccacttgactataaaaagcagaaattcagaattctctttcccagcaggcatagcaaacttcaagctgtgaagcatttcaactgcaccttacatatatactgaactgtgtttcgatttcaattgagaacaacgatataccttgtcctgaaaagacatgatgctgttttccattcccaaccattttcagaagcaaaaatcttacctttcaaagccttacttcttttatctaaaataaaaggaaggaaaaaaaagcagtcatatcaatgctttacaaaaatgcctttgtcaaaattaacatttagctgaaggcattgtagcttaggtaaagcaattcaggaagctttcagaaaatgtcttatagccaagaaatggtaaaattcctaccaaagatgttctatgaacagctaacagccctttcaaatttgcagggctccttaccttctacaatgtcctaaactttagtcttgcagcataaagttttctcttttctctttgtaatcaatggcttagtaacatgtgattgggccacactgctctgctctactgagaaccaagtggttattcctcccctccaaatttttttacaaacaaatttcaaatattcagaacagttgaaaaggtgcaatgaaataccacataccatgaacccataccttaaatattttagccttcatctcttaaaacgaatgtaataccactttcacacctaagaaaactcacaattctgatattaaagtcttgttcaaagttccccaattgggccaggtgttgtggctcacgcttgttaattccagcactttgggaagccaagattggaggactgcttgagcccaggagttcaagaccagcctgggtaacatggcaaaaccccatctctacaaaaaaaaaaagtacaaaaaaaaaattagctaggtgtggtggtgttgggcatagtgacgggcacctgtggtcctagctacttggcaggctgaggtgggagaatcacctgaaatcacctgagcctaggaggtggaggctgcagtgaaccatgatcgtgccattgcactccagcctgggcgtcagagtgagagactgtctccaaaaaaaaaaaaaaaaaaaagaaaagaaaagaaaaaaaaaattccccactgtccccaaatgtcttttatagctgacatgtgctccctgtattttttacgaaggactgtaggtagctctaatgttcatacctagttagaacccatagttcctttacaatgtgaattgtgattctttttgaaaataattttcttcctgacctcagaaaaatcaaacataaggaaacgtaccagcagcccggattttataaacgatgaagcccatcagccccattcctatccaaatctcctggtaaactttggtgtagtagggcttcatggggatccatatgtttttaataatactttgaagcatctgaaaatgaacacagtgattaaaaattagaatgatgattgctttaaacctaactggtaaaagattttaatttgttaagttcaaccccatttcccatgactgctagggagcctcgcctgtgtcagatgtcagacccgttctgcactcacaggggactcacacctcttttttttttaaggtggagtctcactctgtcacccaggctggagtgcagtggcacaatcttggctcactgcaacctctgactcccaggttcaagtgattctcctgcctcagcctcccgagtagctgggactacagatgcgtgccaccacgcctggctaatttttgtatttttagtagagagagggttttgccatgttggccaggctggtctcgaactcctgagtgcaggcgatctgccttgctttggcctcccaaagtgctgagattataggtgtgagccactgtgcctggccattttttttttttttttttaaagcagagatggggttttaccacattggtcaggctggtctcaaactcctgacctcaagtgatctgcccaccttggcctcccaaagtgctaggattacggtgtgagccacagggcccggcctgggactcatgctttccacagctcttccaactcaacccatccccagggccccctcctcccacctttggccatcctagccacttctccttccttacatcacagagctcatccagcacctctcccaccctgatgccatgccctgaactgcacatgactctaatgtctaaatcgaaaaattagtatcttctcatcgtcatgtaatgaatgtcgcattcgaagctgaaaaagaatatggccagggcatggtgatttccttgtgaaactaatgccaggctcagcacactctgatcagctgtatctccatcttgaagtctattgctaaatacaaaacagatgacataagacaacgaggtcacttcataataactgccaattaagatagaacttatttaatcaataaaggtagttacttaatgaattactgaatttgattgggaaaagccattaaattccaaacttacagtttgcttgtatgtgcaggtctcaaaataatgctttttgttacttttacaatttactctctactatagaccgcaaattagatgccctcattttcattttaatatgctttttaacatctgaagtggtccattaaactacagtcaaatagctgtcaggagtgactagatctaagcacttctcatttcacttggaaactgctttggttgggtgtggtggctcatgcctgtaatcccagcgctttgggaggctgatgtgggagggtcacttgagtccaggagctcgagactaatttgggtaacatagggagaccccgtctctacaaaacataaaaaattaaccaggtgtggtggtgcttgcctggctaattttttatgttagtcacagctattggaagactgaggtgggaagactgcttgagcttgggtggttgaagatgcagtaagccatgatcacaccactgcactgcagcctgggtgacaaagtgagactctgtctcaaaaaagaaagaaagaactgcgcgttggctgcggctgtaatgctgcctccacccctccctccctccacccactcactgctcctttcacatcactgctcaggatccaaagaatccgaatgctcggcagtgtgctccctttcccacactgcgcagctgtgtgtgtcagctttaccgcactgaatccttcacaagcccaacctagtcaaaggtcaaatggcggccctcaaatcactgaaacccggatcgtgtggtcatttattcacttggcaaatgtgcactgagcatgtactaggtgccagacattgttttaggagctgagaaacaataaagggtcaggatatctgggagaggaatcctcggcattggcagagactccgaggtcagaatgaactcggagagctggaaggaatagggaggccacagtgccagattcaaatcctggctgtcacttactagctaacttaaaccgcttaagttttctcatctgtaaaacagggataaaaacaggatccacctcaaggggttgttatggagaataacatagaataactctatgtcaaatgttgagtgtctggtactgtatattaaatgcttgttacataaaataccatggctggactatgggaaggaagatgggccatgtcatttaagggccttggaggctagcatagaatttagcttttattctaaaactgttctctaaatttaacaactttttttttttttgctttagggtttttttgtttcccgttttgacaatatgaagaaaattcagtttagaatctggaactggcctggatgggattcgagggcagctggtgggggctgcagagccccttcgattcctcccccaccgtgggagctaagctactggacagaggagcaccaacagggcaccgaaccaggaactaagttagtgtcttgagtcaggcaagaatggggaggccaggccggagctacagcagggactgccctgattgtggttagttctgtctctagccctttaacagcattttaaaagtgcttttcgtacttacttcctacactgcttcccactcctataaagtgggtacttggagaaagctcctataaagcgggtactcggatcccgcagcaggttagcaggactgcactcacaccaaatctgtacgtcatgctcctgatgacgagaacctacctccaacacctgctttcctgctcttccctatgagaggacttatttaggcaaggatggtcgtgagggtggcctgaggtctgaccttgcaggatgcgactgtgtccttctcctggaacaccttgcagatagtccgccctcaaatttcctgtcctcaagctactcgaatgctctgacagtgtgaggttccaagaaacgaacagccctgctttgggaatatgtcacagatgatccaaacaagacccagaggaggtttctggaagccccagactaggagttcagaggcatggagtgaatcccttgtctctcagcaacgactgggaaggaagcattctacaggaccgatgggtttggaagcctgggaatcctgggctccaacaccagctctgcctggtcagctctcaactgtgggcaagtccctttagctgttgtttcagaggtttttttttttctcttttttgagacggagtctcgctctgtcacccaggctggagtgcagtggcggatctcggctcattgcaagctccgcctcccgggttcacaccattctcctgcctcagcctcccgagtagctgggactacaggtgcccgccaccacgcctggctaattttttgtatttttagtagagacttggtttcactgtgttagtcaggatggtctcgatctcctgaccttgtgttctgcccgcctcggcctcccaaagtgcagggattacaggcgtgggccaccaggctcaacccagaggtttctttttctgtgaaacagggatacctccacctgcccccagagggctgtcaatgcaattcaaagaggaaaccaaggccgggagcggtagctcacgcctgtaattccagcactttgggggtccaaggcagggagatcaagaggtcaggagatcaagaccatcctggctaacacggtgaaaccccgtctctactaaaaatacaaaaaattagccgggcgtggtggcgggcgcctgtagtcccagctactcggaaggccgaggcaggagaatggcgtgaacccgggaggcggagcttgcagtgagccaagattgcaccactgcactccagcctgggtgacagagcgagactccatctcaaaaacaaaaacaaaggagaaacctaaaggacccagcctagtgcctagtgcctggtacggaataaaaatccagagaatggactgggcacggtggcttacgcctataatcccagcatctcgggaggccaaggtgggcggatcacttaaggtcagtagtttgagaccagcctggctaacatggcgaaaccatctctactaaaaatacaaaaactagctgggcatggtggtgggcgcctgtaatcccagctactcgggaggctgaggcaggagaatcgcttgaacccgggaggcggagcttgcagtgagccaagatcgtgccactgcactccagcctgggcaacaagacactccccctttatcttaaaaaaaaaaaaaaaaaaagaattcagtgactgatcacagcagtaacagaattgatacaaatatccagttcatggctataattaatactaagccactgggactctaacaagaaggaaggcttaaaaagacgccctcatttaggccaggtaggggctttggacagaacaaggtaagatgagggtctataaggaaaagggcaaagtaaactgggagggtacaatgactacggtaagaagggactaaagaaactgagtcatgctgacattgtgctccgggcccaggcaccctggtatggtctccttacaaaattacccttagtccccagtgcaacaggggcctgctattcagtagcttgcaaatacctttcccttcctttccccttgacttcagttgccatatttgcctggacaagtgacatgttcccaatacataataaaacgagggccccccctttttttttttagacagagtttcagttggtcatcaggctggagtgcaatggtgcgatcgcggctcactgcaacctccgcctcccgggtgcaagcgattctcctgcctcagcctcccgagtagctgggactacaagaggccgccaccacacccagctaatttttgtatttttagtagaaacggggtttcaccatgttggccaggatggtctcggtctcttaacctcgtgatccgcccgcctcagcctcccaaagggctgggattacaggcgtgaaccaccgcgtccggcccctactttttttttttttttgagacagtctcgctttgtcacccaggctggaatgcagtgacgcgatctcggctcactgcaacctccgcctccagggttcaagcgattgtcctgcctcagcctcctgagtagctgggaagctgggactacaggcgcgtgccaccacactgggctaattttttgtatttttggtaaagacggggtttcaccgtgttagtcaggatggtctcgatctcttgacctcgtgatccgcccgcctcggcctcccaaagtgctgggattacaggcgtgagccaccgcgcccagctacatattcccaacacataataaaacgacagcccctacttttttttttttttttttttttaagacggagtttcactcggtcatcaggctggaatgcaatggcgcgatctcggctcactgcaacctccgcctaccgagtgcaagcgattctcctgcctcagcctcccgagtagctgggactacaggtgcctgccaccacacccagctaatttttgtatttttagtagagacggcgtttcaccatgttggtaaggatggtctcgatctcttgacctcgtgatccgcccgcctcagcctcccaaagggctgggattacaggcgtgaaccaccgcgcccggccggcccctttcttgagtccattctgcccaggcacatttcctagctgtgtgtgtcagttttacagcaccagaccttttaaaaatccatcttattcataggccaaacgtgtgtctactgtatccacttaagtctgcaaagttttggcacattacattaagggcgaactattacctgacactggaaatgggaaatgtctgacccgcgagttccatacaatttcattcagcaccgtatgatctcttttcagcttccctgttgcctcacccaagttgtcatgtacagcataacgtggagggcagtgtggcgcaaggaaacttgagttataaaggagagaagggactggatgtggagtcagagttcttggcttggactctggcttctctaactctgcgtagcctctgggttaggcagctgaacctctcaaggccaaggtacgctccctgtcaaaaccgtgggagaattcaggtgcactgagcgcgttaaggccaaggagggaaacgcggcgcaggcctaggcgatgcttccctctggcaaccgaccctggcctacctcccttcagagaagggaaagccgggcagaaaagcaggcgcgtgccggcggaggggtggaaccccaagatcagctggggccaaggcggcttctcgccctcccgcccccgccgtctcgcacctcgggagccaggtccaggtccccgtactcaccttggcgcaggacagacggctcagaacgcaccacaaatctgcagccaactcggaaaggtcaccgagcgcgcaggcgcgcgcaggggatgccgggaag

SEQ ID NO: 1303 - DNA, 1884 bp, Homo sapiens
attcgtattaataatttatttaattctatatgtagcttcattgtagaataaaagtcaaggttaatatctaagttttgtacagaatttgtcagacttcatactaaagttgctttagttcctgtgaggtgggtttgaggtataagaaaatactgcaaacattttttcaaaatacttaggaaacattttagttaaaagcatactattcaatgaaaacatagcatgtttagagtggttaaaaaaagaacactatttaaaacataggctacatccacaggatactgaccttgtaacaaagaaaaacttgaagtcacatcactttttcttattcttaatattaggagttctaaggtgttcataaaaacccctctagttgtaagtaacttaactagatgggtgataatatggtaggttccatattctgtgtgagaacactgggaacctgtcctttgtgtttttgtctacgtaactggaaatggtgggtatttcatctttgtctgccctcttggagctgtcaccttggatcacagaaggagcagagcagtccatgctccctgagtcctccaggtcctcttgctcactccctctgtcagagctgcttaggaagtctttcagaacttgcttgaagatgtagactatttcccatggcagtacatcattttctgccaaaacttctcgaaatctagaggggaaatggtaatgaatattcagtttagaacattttttgttatatctctttatctccaaaatacagcttgaataatgtatacaagttacccaccttttgagtattttgcatgttgttttaaaattatgcttctagtaaagaaattttaaatgtaatttaaaacaattgctcaccagacatctacacagttaaagaatttacatgatagaatacagtttctagtcaaaatatatgaggaacttggacttagcagtagcaggaatcataagagaacatagtatttttacctgctgagaatagttccagtttggcaaggttgaacttgtgagcaaagaacttcaagttgtctttgttcagtcactgggatagttgtgtggggattctggtagtttctgagccagttgtaatccacacctgtttttttcactttttgttcattttcgatttcttgtattaatctctctcgctcctttaggtgccattttaattcccgaagcagagtctttgtcactatgtctgagccaggatagtgtgtgggtttgtaggaatcgtttttgggccatttcatccagccaaaaagtggcatttttagcctatggaaatattttcacttgtttatttgctcaaaatgttatgttcttctgagcaaatatttgtttctttacaataaatttgcccgaaaagtgcacgattttttttcacatttagctatgcaggtcaaaataagattagaacatggattaacgtcttaatttttaactaggtcagtggcagaaaccaagctttgaaaatgcttttatgtagcttagcagaaattagatatacaaagtcagagataacatatagactgaatgatatccgaaaataacactaacacttgctgtgaaaagttcttaagagacttaaaatattaatgtcggggcaagtgctgcctacagatacttttgatttatgttttggacagaaaaggtttaaagcttacctgttaagttgatgggctgatgtgatgttgccaaagagttgactgaagttggtgacgaagctgtgtttcactgggacgtatcttgctctcctaggtgtgtcctctgtagaaggaatgcgccaccttatttacccaccgaaactgtatttgaaataaataactttctgtgttaggaatgaggctgtgatgtcttcatttggagagaatgctcattaat

SEQ ID NO: 1304 - DNA, 9280 bp, Homo sapiens; identical to SEQ ID NO: 1302

SEQ ID NO: 1305 - DNA, 111 bp, Homo sapiens
ggtgttggggactcgcgcgctgggtccagtggttcttaacagttcaacagttctgtagcgcaattgtgaaatgtttaggaccactagacccggcgggcgcggcgacagcga

SEQ ID NO: 1306 - DNA, 27025 bp, Homo sapiens
gggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcggtgagtccgagaccctgggcggggtaggcctctggacctggccgcgaccgggagcctcggaccctcctgcacccacgggggtcgttggggagtcaaatccgcgcctggatggggggtgcgggctgaggtcgctctcctccggttccggccaccggcgtccccacgcatggagccccgacctggacagaggagattgcggtgggttctcgccgtcgcggtgctcccgggagcgccctgcgaccctggggccaggccccctgtgctgccgctgcgcccctgagggccagcgtcctgaagtcctggaatatggggcgggagggccccagggcattggcctgccgctcctgctctggacacagaaggcttaggaggctgccctggagaaggcttaggaggctgcgaggacccctcaactgcgacacccaggagggtgtccccgtcccctggggtcctggtcaggcagcagtggttggcacgatactggggctacctggcatctgcggggacgcacgtgttcacacccgaggtggcctcagagccctgcttcctctgcccctgtgtggacctggttgaccagagaccagcgattgcgtctggactgagttctgcctgggtggggtcagggcctgggacaggcaccgagctctgtggtactccagcacagtgctgccagcctgggctgggcacaggaaggatggtagcttggggagcctgaggccaccgggatggggagaggacggttgcactggagcctccagaatgcctgggtgttccccaggagggcaggacactgcctggggcccccagatgggctctgctgtgatgtggggcctcccttggggccaggacagccccctcgccccgtcttgaacctgtttgcgaccctccatgggccactgcctgcctttccctcaggagccctttccactcctcctcctcccactccctgctgccctggcccctccccacactcctgcttgtgtccagcgcagctctctctcctgggacggctgggaccctctccggctctgccagagcccagggcctcccctggcatgaccagaacattctcttgtcccttgcccatctgccaaccacttccccgcccctcctatccccaccccctctcacggcctgttccctggcagctgcccctcctggccacccctttctgctgaagtggctgctcagaagccaccagcactctgtcggtgctctcagattccacccaccacactgtggccggtgcagacccctctggaggcccactctgcgcccagcccaggagacaaagcctagtggggctcgtccacgagggactcaggtccccaagaacgtggctgtccaggctgccgggagcctcctctgcacttctccttctgcctgtgaatggaacaaagtcattcacagcttggcaaacgcccctgtgtgacactccactgacacagagtgacacaattcctgtgcttggccctcacaagctagagagagaggctgccattgaagggatggcatgcattaaggagctagtcccaggggcaggatctgccagggccctgtaggggctgtgggctgataacagggtctgagctgggtgtgtggatggtgtggagtttggaggcagcccagggagggcttctctgaggacacaaggcctgcaggacaaagatgggagagggccaggccaggagcagccctgcaaggtgcaggaaagaggagtggggagcccagcagggccggagcctgccagagctgcccccgagtggggacaggacctggggactctgtgtggggcctcgtccgacgcccctgacgctaccccttcaggcttggagtgtggccaactgcagtttcgttgagctcaacatgtagttcttgagtggtccgagctgcaggggcaggtggactctgtaaccccaccacacacccgtctcgcttggcccccgcgtgctcgccgcagcagcctgtgggtgcactcacacgcgtgcaccgcatttctgaaagaggctgtgaggtcctgtgtctgggtgggaaacaagagacttggaggctggaaattgggtgtggggcgtcagtcttcagacctgaagcagccttctgagatcccttggtgctctgtgcactggggtcctggcttctgctcagcagcccgtcctcgtgtggctgcgaggtcacccccagctgttgctagctgacccatgtggggcatccacttccaggaacctgcaggaatgggctcccccaacccctcgtgaggttggagcagccagactgtcaggcgtcaatgatttactccctccacactgctgacgtgggctctggccttccctggggaggtgagaggggagtggtggctttgccctagtaaagctgtttgattgtcgctgttggaacggcttctgcgcctgctggtaaacagtgacctgtgggtggaacgctgcacacctggagccctgccagagttcagggagggcagaggtgatgccagtggggacgccccttgacccatcccttctctgagttcattgaagctatcacaggtcaaggggcatagcgaatccaaacacggctgataaccccaagcccaagctggcatcagtggccacgttctgtacacccgagaaacttgaagacttcctatgtcaaactgggaaccccacctgcttgccggcctgtcccaaagtccctcctgagcccggctccttgcaggcacagcagggagggcagagatctggggccaggcagctgagagaagctccctgcccggtgaccacacgggtcccagcagtcgagagtgtcagtggagtgatgcccatggcttcttggttactgcagtggcgtctgtgcccttggcctggacctccttcctgaatgggtgctacacgttcacaagtttctaagcctaagcttgacttcgctggtgacagtggggcccattgtcttagagagcaaagcctcctttccaggtgtttggcagggggctgaggagtttccaagtcaccagcaaactcaggcacctgcctggatgggccaaggaagaggttccaggcagggctggagggttcagattctgcagcccttgaagcttttggagggccctcattgagaaaagtaatacaagttacaaaatcatagttaggtgtgaaagccggtgtttgtttattttttatttatttttatttttttgagatggagtctcactctgtcgcccagactggagtgcagtggcgcgatctcagctcactgcaagctctgcctcccgggttcacaccattctcctgcctcagcctcccgagtagctgggactacaggcgcccgccaccgtgcccggctgaaagctggtgtttatttaaaataacaaaagaaattgccccagctgactgggcgcggtggctcacacctgtaatcccagcactttgggaggctgaggtgggtggatcacttgagatcgggagttcaagaccagccatggacaacatggtgaaaccctgtctctactaaaaatacaaaaaaaaaattagccagatgtggtggcagatgcctgtggtcccagctactggggaggctgaggcatgagaatcgcttgaacccaggaggtggaggttgcagtgagccgagatctcgccactgcactccagcctgagtgacagagtgagaccctgtctcaaacaaacaaaaaaaactgatgccactacatacctgttagaatggctgctgacgtacaacacattgactgcggggtgagtgctggagccccagagttggaaagtggtccactcgcaggttggtaagaaaactttactggcgacagtataggtttgaaaaaggaacgtttggccagacatggtggctcaggcctgtaattccaacactttgggaggccaaggcgggtggttcacttgccttgctaacatggcgaaaccccgtctctactaaaaataaaaaattagctaggtgtggtggtgcatgcctgtaatcccggctactcgggaggctaaggcaggagaattgcttgagccgggtgggtggaggttgcagtgagtcgagatggcatcactgtactccagcctgggcaacagagtgagactctgcctcaaaaaaaaaaaaaaaaaaaaaaaaaaaggaagaaaggagaagaaaaagaaaaaagaaagaaattggccaggctggttttgaactcctgggctcaaatgatcttcctgcatcagcctcccaaaattctgggattacaggtgtgagccataaaaaccactgcaaaagcacatatggagtgttttgcttgagagaagaggacaccaagagagtttagtcttgtctttggctgatttcgcctgtggtgcccacacatgcccccagcagggacagcagggcccatatccacgcctaccactctgcagcattcctggaagtttctggaagctgttcccccacatgagtcagcagcagctggaggtgaccttgcacaacgtgagcatgtcccacaaaaccaaaccagatatgccccctccacctttcccataaggcaccccagcttcacccgccgtgatgagtggagagtgactttttgtttcctgtggccactgtgccgggcggctgaacatcacagaagttcgttctgggttctggaggccgaggcctgagaggggtttccccgggctgagccaaggtgctgcagggcaccgctccgtcctgacgctctgcgggaggagccacccctgccacctccagtgtctggtggctgctgcaatccttggcttgtggccgcatcactccagtcatccaggccagcatctccaagggccgctctgccctgtcgtcatatggccttcccctccccgtgccctgtggccttccacctgtgaggaaacacgagagggcgtttagggcccacctggattgtccagggccacctcccgccccatgacccctaatatcacatccgtaaagacacttccatatgaagtgacacccacaggtaccggggattgggatgtggacatctttttaatttttatgtatttatttaattttttgagacagtctcattctgtcacccaggctggagtgcagtggtgcgatcttggctcactgcaacctccgcctgccagattcaagtgattctcccgcctcaacctcccaagtagctgggattacaggcacctgccatcatgaccagttaatttttgtattattcgtaaagacagggtttcaccatgttgaccaggctggtcttgaattccagacctcaagcaatctgacacctcggccacccaaagtgctgggattccaggcctgaggcactgcgcccggccctgggatgcggacatctaggatgctttttcaacccaccatacatgagacagggacacttggacaccggtgtggggtggaccctgagccccctggatgcccagggtctgaggttgggtccttggggttcacaaggctggtgaatccagacctttgttccggcagcccgtgtcctggctgtgctctgggcgcctcggagggcagacgggcagacaaacatgtgcgggctccgcctcccccgtctgctggctgagccctactggcggggtgattttgtcagcggctgcacctcagccggcctgcatcttccagtcctctggcaaacgtccccggggctccacaggcctttgtgtaaggccagaggaggatcacgggtgccataaaccttcacggggccaagggctggtgtcccggggctggtgacttaacaggcagagatgtggagaccagggtgagcccagcagtggagggcgatgtcagggaggggtgcggctggagggatattagagggggctgctttaacttgccaagtttggggttaatttgtgagccagtgataggcgatgggtacagctgcagagggcgaggggggaaagcaggtgaccatggctgggatctgcaggataggatggggcattgctgctgggggagggaagggagggccgggagggagctttgggacttgctggaggccctggaggggtggctgaggggtcagggctttatactgagcagctggccccagggaatgagtggtgtggccaggtctccatttaagggacagaactgagatgcagaggctgcaggaaggtggcagagttgctgggggtgggaccagcccgtctgtgcacttgctgtgtgctaggccctccaggtcggggagctggggaaggggacctgggctggaccctgagggagtcacacagtccgtgccctttgggagctcgagggccagtgagggagaatgtgggaatagcactacagcctgggcatctgggagggcttcctgggggtggtgtcccaatctgggccttgaggcacctactgggtgagaagtggggacgaggcaggacttccaggcagagcccacagtatatccacagtgaggcaaaggctgagccccgtgggccttggtggggagtgtggactaagcatttggagaaggaggtgggagcaggggcagggcctgggtggagcagctagagacctgggcagagctcctggggccgtccaggtgcgaaatgaggaatcaccacgggctccaaggcaggaagccatggcttccaaacgcgggtcagccgcctgccctctgaggggtcccaggggcagccatagcccttcctcccagcctctgactgtcataagaccggagccccatcccaccagctctggtcctgcccctcagtgagggaggaggcggccatggctgtcagcccctgaccccagcatccacctggactctgcctgcagtgcttgtgcccgggacgggcctggctgccatcctgaggacactgcccatgttccatgacgaggagcacgcccgagcccgcggcctctctgaggacaccctggtgctaccgtgagtgtgggctcctcccagtcccggacagggcatggctgctgaggggcaccgatcctgaggctgggcactgctggccaggcccacgtgagccatttgctcacccctgtctctaacatcccctcagcttacagggctttaggactgaccagcagtcgccttccaccagagcctgaacctctgagggtgccccgtgcctggtcccaccttccctccccaccctcctcccacacccccagccaggctgcttcggcaagtgtgatgagggcgccccgtctagggatcctgtatatcaggagccagctggcccaggtggccttgcccccagcatagaggtccttccatttctcagctctgggcccagctccctgatgtcccccacagctgggggtgagctgggagttgccctcgtggtggctgaccaccacagccgccacaggcgagcctcctgcaagcatcctctcctgcctggggatggctggtcccagcccccctcttcgagctggtgtgggaagaagactgctgggagtggcccatcctgacctacgtccttgcctctgtggggagctccaggtggaaggggggccgggccccgtacctgggatgctgagaacttgctatgtgcggagcccttggcgtaggggccccagctctgccagaggggaacagagcgggtcagggcatttagagcaggaggaggtgcagagcgggagcctgctgttccgcctcctgctgtttctgtcccgcagcccggccagccgcaaccagaggattctctacaccgtgctggagtgccagcccctcttcgactccagtgacatgaccatcgctgagtgggtttgccttgcccagaccatcaaggtagtggggctggggaatgctgggtggggctgtggtgtgtgggtggggctgaggtgtgtgggtggggctgtggtgtgtgggtggggctgtggagagtgggcagggctgttgggtgtgagtggggctagggagcacgggtgggaatggggagtgtgggtggggcttggagtgtgggcggggctgtggagtgtgggtggggctgtggagagtgggtgaggctgtggagtgtgggtggggctgtgggtgtggggtgggctgtgttgtgtgggcagggctgtgttttgtgggtggggctgtgttgtgagtggggctgtagggtgtgggtggggctatgagtgtgggcggggctgtgggtatgggcggggctggtggatgggcagtggccggcagaaacactctgggacgggtgaggagctgcagggtctggggtggagtcggcctgcccagcctggggcctgggagcatctgggaatggcagcttcaggaaagggcagggtccacgtgtcagagctgcgggcaaggctctgagttcctctcccccatgcaagctgggggtgggcgtatagggccaagtcgacttcccagatgaggacacaacgggaacagttgtcttagcctgtcccagttagtatctggggcgcggtgtgtggtgtgtgatgctacctcgagggccagcaagctccttgtgcgtggctggtgacctgctcactgccctctgtccgtccccgcccagttggagtcttagtggatttagtggagtcttggttggagtcttagtggaccacagcacctctcaaagactcttgtggtttacagcgacctgtgtgctccccctgcaggcagaaccaccccccgccccatcagcttttcttctcccttctcccccatcacaacacgctcccatgttaccggagctgcctcccctagtagggggcctcctgcccgctccagtcccaattctcacctgcttcccttacgaaccccctgctcccctgagtgggaacatctaggcttccccttcccagcagcagggtggcaggcagcaccacccaggacaggaccctccatttgtagccggcagccctcaccgggcaaggcgtgactgctttttgaggcccacgaagctgccctgcggtccttgctgcagggagcagccctgggcagcctcacaaaggccttctcggctcaggtggcccagcctgccgtcttgccgcgagtggccagcagagggcgcccttcccctccttggcctccgctcctctgcagttcccaggcctacggggcttggtcttttaatggccccccgggcaggcccaggcttcgtatggagccctgggctctcggaacggtgccctggcagccgcagcctgggccagccaccctccagggggtggtggccggaggacgtccctgcatggccagcttcactgctgcccttcggtgtcctgcccggccgcccaggtccagatccaggcaacctccaggatcacctgctggttcccggccatggctgtgccttgaccctgcaggcgtccttgtgcccaccgttgtgttcttgcctgacccgcggtctgggcttcgaggctcgtgcaccaccacagccccctgctgccatggagaggcgctctcccgcccttggggagtgtgcagaggccccttggagggactcattctcgagtgctctgaggggagcctcagcgtggtgggtgcacccgagtggcatggaagcctcggggcagggagagcgtgggagtcccaggactccacgccaggggctaatcttccagagagggacttccaggccagggtcccacgggtgcctcccctgagtcctcctctctgcatccggaccctttcccccatgctgcaacctcccccacacctgcttgcgaggggctggcctgcctgagcatgcgcccctcctgcagaggcactacgagcagtaccacggctttgtggtcatccacggcaccgacaccatggcctttgctgcctcgatgctgtccttcatgctggagaacctgcagaagactgtcatcctcactggggcccaggtaatcccaggggcccggggctcctaggaacaggggcttcctgaggccacagggcaagtcagcgctgtgggcggccgctgcgggaccccgggcttcctgctcagcccagcagctcctgaggtggctgctgcagggcccgtgctggggctcgcaaatgctcaggtcctgcccgggtgccagcaccacctgccccgcaggaggggggtcatctcctgctggtggccctgggagctgtgaggccctggagcacccagagccaggcccacctcggccctgggggtgccaggcatcccttcctctcctcccgatgcttccttgcggctgctgcccacctctccatctggcgcatcagggtggccgcgcacagagccgcaccaggaggccccggccatgtccctgcctttgtccctctctttgctccgcccactgtgggtctaggcgatgccatcctgggggccctggcacacgatttccctgcctctctcaccctaacccagcacaaatcccataagccaaggccagtagagtgttctggaaaactggatttgaggggatgtggcaggggaggttggctagaagctgactaggggtccatgttgcctgcgggtggcagtgggcacctgaaccccttgggatcctttcccacggctgaggctaaggtcttgtatgggaaaccggtacctgtgtccctttgagcttggtggcagttccagaaagctccatggaggccctcttaggaggtctgcggggagcagtccggggaggtggctcagccaccccactctgcttgcctggcgccgtctcccttgtccctccagagtctccccagggcccactgcacacacctgttagcggtggagcagtgcctcccgccccagaactcgagaaggagggacagggctccagctggttctcctcttcccagaccttcccgagccctgggggagcagaacatcccgtggacctctctaggggatcaagggcacagttatgagcaccgcaggacccacgaacgttcacatgcatgttgtcctcactctgatgttggcctgtgccgggacatccttatccctgttatacctgtggggaaactgaggcttacaggctaggggctcacccacagccacgtaccacgtgagggctgagccagggagcacccaggacccaggactgccaccccctgccagggctctctccctccagagcctctgactgaccacttcccggccgcctcctcctgaaaaccctggcctctgcaccgccacctgcgccctcctgggacgcgctgttcagtcaaccatagcacagtcgcccatgctagacacaggcagctgtgggaggagctgtactgtgcctggcatcccgaggcagttcctttctgtcacagcccacccacccctcacccccaccaccctccttccagcccatagttctgctggggtagcgagggagctgggcagggcagctgcggtgggaggcctgtgatgcgttctccagtatggggaccggctggcccctgctgccagcactgggctcttggacctgtagagggagctggtgggtgggttgaggccctgggtgcaggctggcatggtctgcagccacagctgttggtgggtgggttgaggccctgggtgcaggctggcatcgtctgcagggacagctgttgttggcggccttggagacaggcttactgcccagctcctctgagtgccccgttcccccaaggcacccatctccaggctgcctgctgcagtccaagcccgcctgtccttctctttcccacacccgcctggggctcctgggctgggcctgggggtttacctggagagatgagccagacatcccaggcttctgggcttcccaggcctcagctactccgtggcctctcccccaggtgcccatccatgccctgtggagcgacggccgtgagaacctgctgggggcactgctcatggctggccagtatgtgatcccagaggtacctgcctggtgcacgtggaggcggggcaggtggggtgggggcaggagcccagacagcagccaggaaacaaagtccccccagcccctccccagacgccactgccaatagctgggtgcactgtcttctagatcttatgttgtggatatttacattagaggtacgtatggaagttctacgttagagatacgtatggaggttctgcgttagagatgcatatggaggttctacgttagagatacgtatggaggttctgcgttagagatgcgtatggaggttctgcgttagagatgcgtatggaggttctgtgttagagatgcgtatggaggttctgcgttagagatgcgtatggaggttctgcgttagagatgcgtatggaggttctgcgttagagatgcgtatggaggttttgcgttagagatgcgtatggaggttttgcgttagagatgcgtatggaggttctgcgttagagatgcgtatggaggttctccgttagagatacgtatggaggttctgcgttagagatacgtatggaggttctgcgttagagatgcgtatggaggttttacgttagagatacgtatggaggttttacattagagataggtatggaagtttctataaaaacaggttgcagccagcagggctctgaagggtgtcactttccctcccccatgtctttccctgtttcctgtggcgtcccaggaaggagtgtgcaaagatctcccccaccctggggcagtggctttacccaaggctcttgagcagcttgactagagcccccacacgggctcctgagcaggggcctcagggactcccattcaccgtgggcaggggcctccagcagctgtgctcgctgcacctttgggatgagttcccagggctctgtaagaagcagggttgggggcagtgggcaggtgggaagggaaggaagtacggtaccctcctgccacccagccacttgcacgccccaggccctggggtccccaggcccctgcaggctccggttagcccacgggtaggtggcagggcaggaaagggcccgagaggggcagtacctgctcccaggaaggtctctgcctgcggtgggtggggttacagtcccacctccccctgggtctgggcacctcattgatggcagggaggaagctggagggcagatgggtcggggacagggtggccgctgctctgaactctgtcgctccgttcccgcaggtctgccttttcttccagaatcagctgtttcggggcaaccgggcaaccaaggtagacgctcggaggttcgcagctttctgctccccgaacctgctgcctctggccacagtgggtgctgacatcacaagtaagccccgcaggagcagggccaggtgcctgcccagtgctggtgctgggcgaggggctgctgcagggagctcgtggctgggactcggcagagtttgagagcaccatgcttggttctgacttgccctggcttggttctgccctgggctgtggagaagccagggctgcgtggacagggctgctgcgtggccacagaggtgggggcctcctcaggtccctgcaggctcagaggcgggaggcctggaagagaggtttggggcatctggccctcatgtgtcctgcccaaccactcgccccaggcctaggaggtccccagtgaccacctggctctgccacacctctgtgtgccgtagcctcgtccccaggagtttcagggagtctttctgtcctctggttccggcgggcagcccagccatccttgtggggctgactcgagcgatcctgtgtcctgaggcttccccctgggggggccaagcccgccccctggccctggctgtaggagcagccttggagcttgttctcagagactggtgccctgccaggcctcacctgagacgcagggccactccagtggcctgcccggaagtcactccctggcctaccgtcgctccgtctggggtgtgctcctgctgagggagcccctgcttcctggactctacccggcccctgcctgttccaggtccacggccagcatggccagtcctgaccccacgccagcacccctccctgaggcagcgggagcatcccctccctcctgggagatgcatcctgcctgccctggccccctgctgtttcaaggcagccccaaacctgccctgtgtctcatcctgactgactgaggtggggtccagccccggggaggctccagggcttggcagcactggccttcctttgggggcatttgacacctcacccggggctgggtggggctgcctgcccaggaccaaagcagctgttcctgtctgggcgggtggggtggaggcgccccctcacccacactgggcttctgtccaggcctgggccatggcgggctggtgggtcaagcccacaaggtcactggacgcctggggaggcccttcctagggaatctcccggtgcggcagaggctccccactcccccattttaaggaggagcagaccctcctggagaaagggttgggctatgggctgctggggcacagcttcctggaagaatccccagacacaggcaaggaccctggggagcttcagggcctggcatgagggggccctgggaagggtctggcagggcaggggccttcctggagcatctaccagaagtcgggggacaggaggggctctgggcatgtctggctgtggggccgtcagcagaagcgggtggaggcagcgtctttggatctcaagacaaggcctgtgtgtgggagtccgggctcggtggctgacttgcttgttgccccagggcccctcagcaggacaggacagaggaaactgcctggttctacaggtgagaaacggaggcagagagaggcaggctcccacagggaggcaccgactcaagcctgtgcgctgtctcctgtcctgggctcacaccccgtcccttcttcctgctgttccctcctgtcctgggctcacaccctgtcccttcttcctgctgctccctggagcaccttctagggagtgtgaggcccagaacacatcagtgtgtctactgtgtgtgcagcacaccgggtctcaggggcttgggcaggggcccacttgctcaccgagggccagggcagccctcaaggcttcttggaggaggtggcttgtgagctggtgctggtagggtactggcttgcttgcccatgctggatgctggcactcggcccctccagcccagggagaaggagcagcaagaggtgtgggtggtgccctgcaggcccggctcccccatggggcctgattcacaccttatctggggctcaggagtggagcttctgctggtgggtggaccccgccccaacagtgcacagaggaccgtgctctggattccagggactccgccagcaccgggtgctaagcccgggcaggccacgaggctcaagacacaccggcctcaggcccagggccgtggggcagctcctgggcgcagcactaaggctggtctgggtgggaggctgccctggccccagccccccacccctgagtgtttcccacgtgcgtgtgggtgtgggaaactgatgccgggctgccgggccggttctggcacccagtgttgagaaacctcaggccttgcccagggcgtggctgctggggcccctggggaggggcacaggttggcagtgtgcaccctcagcctctctgagccagctgggggtagcaatgccggcctgggcccgggtgccagctgccagcaccctgtcgagggcttgtcctgggctttttacccactgtctgggaagtgaggggctgggctggtccgggagtcatgggcgggcttggtgctcctgtccacagtcggctcggcgccaaggggtggggggatgcgtgggaggctggaggaggccctgctggccctgtcctttccatgtgtctcaggagaccacactgtcacccccaggcaaatcctgcacccttacccttctgtgctgagccctgaccccggcccactctgctggggcccttggagcagaggagggtggagaaggggatatggctgtggggtcaggccaggcctgtcactcaccagccatgggtccttacgctgggtcaccccaaagcagagccccagagccctcctctgtgcactgggagaagccacctccctcccagacgtgacccagccaccccagctgtgccgcatccagctttgaggccgcagactacacccttcggctcctgtgctgagctcccgtatctgtagaacagggccatagcccctcttgggggtaaggggctgagcctgcaggcctcacctggccatggagccaccagcgctcctctctgcccccgggtgtggggtcacgattcccctggcctctagcaggcctgggcaggaaggactgggatcccaagggtggcatccacagactctcaggaggcgggaggtcagtgcggggtgggtgtgggccctctttgtctctgtgtagccccctctcagccataactctttgccagtggcagcggtgccccctcctttcctgtgctgatgccttatctgcttgtccggctgagacacacgccctcagttaaagggcatctcacgctgccatcatgtggggctgactgatgctgtgggctctggtgggggtggaagactcactgctgggggctccgctcccccctctctcatccccagcaccccacatctccccccttcagctccaccatgccaggaaagtcctttttatcgcatgcaagctgctctagcggaagcggccggagacatgtgggtgacatctccctgtgggcaggaggaagagccctgtgcgggggtcctcctgcccaggttcctgtcccagcaccgtgccgggctctccaggcgcccaggcccttccccacccctgggcctcggttttcctgggctgggctctccagcctccagggtgtttactgccctgggcagctctgacacctcacagtgtggtgggagtccccagtgtccagccctgctctgctggaggctgccatgagtgtggagaggggcagagggaatggacctcagccttggcgctggcctctgagggtttgggggccgggcctgtggcatcagcctcccacccccacccacatggagcgggaaagtcggcagaaccctgggggctcaattgctgccagagtggcggccttcagctcgaggacaagcatgtcctctggggagcccctctgcatggacgggttcaaggggcactgaccccaaatagccatccctccccacttcacctggggcctgcacctccaccatcacccaccctgggtgtggggagggggtgatgggcacacattaggattttggggtgaactggatggaggccttctctccccagaggtgaggggtccgaaagtccatttgttcgctcattcaaccactgacccggtgggcagtgggcacagtgggtgcctggcaaggggcagaggaggctggctggttcgacgatgctgccccatgcctgtaacccagcgcagtgactgctggtggctccccagctgggcatgcctgccctcctcgcctctgcgctcgcctgacgcccccatgcggcctgcaagacacagccgggcctccatctctgcaggaccctcctgcccctcgcctggccagcggagtttccctgggcttcacccttgagactgtgttgcccattgctcggccatcggtctctcgctggccaacgagtgcctcctcccacagccccgtgcacgctgcggagcctggcacaggccggactgcgcggaagcccgggaggatttgcctgcgggagaggaggcagggcgagggggctgagccgcgaaggctcagggctctgaaaacaagggaggaggcggcctgtgcagagggccaggcactgggctggggtctcggctggcaggaggcctgaaggcaccacacaggcccttccctgtcctcagtcaacagggagctggtgcggaaggtggacgggaaggctgggctggtggtgcacagcagcatggagcaggacgtgggcctgctgcgcctctaccctgggatccctgccgccctggtagggaccgccccggccatcctgcccctgcagccctgagccccagccctctgcagctcccacggccctcaggctccctggggccctcaccagccagtgcagaccccgcgtggacctgagatgtctgcagtgtggccccaccagccccaggccctgtcccctgtcctccgtcgtggtgctttccagcctctcggggagtgggcagggttggggcgcggctcacagccagaacggggtcctccatgcttttctagaggcagcgtcctcccgcagattccagctggctgggagccgcccctgctgtgctggacaagggtgtttgctctggggcctctgatggccttcttggctcctctcccacctctctgaagtgtttccacggcgttctgccacacaaagccttcgtccctacagacagggcgaccctttgggagaatgtggggggagcagccccctccaggtgccagcagccatgcacgtctgccaggagccccactgtcccgggagcagagcaggcaccagctgcccctggcttggggtccctctccttgggagggcatggggcgagtctcagtggtgctgagggcagagaccctcaccatccagcccccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggtagtgccgggagatcagggcctagcggggaaggggacagcctgagggcctggcagaggtgggctctgacccacccctcatgggctgggggccgtggtgagtcgcccttcctgcccacacgccccctcctcacaggccatggcgggagccggcgtcatctcaggcttcgacatgacatcggaggccgccctggccaagctatcgtatgtgctgggccagccagggctgagcctggatgtcaggaaggaggtgcgggcgctctcgggctgtgggcaaccctcggtgtgcacaagcatgtcagttggctcccaggggcatgtctggggcgatgccggaagagcctgggggccggtccagggtgtgtcctgtttgggaaggggagggatgtggctccctatagtggggaagggcagctctgggcccaggctccccacagccctcactggactcccagcccaggctccgcctgtccttgtgccttctcagactgcatggagacctgaggctcccctaactgtcgccaggaaatcctctcctgctctccactcttcctcgagggtggggttcagacacagctggccccagacccttgggttgccagcctctggggctggacggaggcttttggggcccctggagaccctgagctggtagggccagggagtggggctggccttgggaggggacccagcccgctctggcccgagggatgaagcacacacggccgaggctcaggccaagggcaacccctgactgtgcccgggtagcccgaccctccaggctgtcctgggctgcccatccagccctggcagagccacttcacctctgttctctccaccagctgctgaccaaggaccttcggggggagatgacgccaccctcggtggaagagcgccggccctcactgcagggcaacacgctgggcggtggggtctcctggctcctcagtctgagcggcagccaggtaatggcgtgggacacgggcctgagtggcagctggggactgtgcaccctcttggtcaccctgggatgcaccaggcaggcacgagcccctgtagccatcactcgagcccaaacagttaggcacacccgggttctggggcccaggaggagggtttggggtctgcagcaaggaaggtttgcagggtctataaggcaggaggcaggaagggccaggcggtgggcacacagcagggaggccttctgactggcggcgctgccttagtgcggggctgcctcgggagctgcctgtccagaagaagggcgggtgagtgggggcggtgcttgctctgggctctcccaggctctgagcaccaggggttccaggtgaggaacccggaggtgagggccagcctttgagcacgtcccctgcacaactgaggtgcccagacctaggaaggggggctttcgaggcctggggtctgcagggggatggggcctccctggaccccgcaacatgcccccttggctgctgggccaaacatccaggcctgacatggggcctggcaggccagacagccttgctccccactgtgtggggtcctgccccggcctcagtgcctcggtttccccctacagggatggacctgtcttgtgagccatgtgctggaactgccacttgctggggcgggtgatgggcagatggaaaggactggcgtgcatggcctgttattagggtggctgcatagggcctgaatgctgtagggaggcaggccagaggcagcagccttgtcaccaggccacgttgtacccgctgggtgtggtggcacctgtggggcctctgccaggaccgctgggtgtggtggcccctgtggggcctctgccaggaccgcggccttttggcgtcttggggagctcctggtgcccggtgctgggggcaggtggctcttctgggaaggtgcagccgtgggaacagggccttccttccaggggaggggtctggctctgcttcccacgctctccttatgtgggtgaccattccgtcccgacggcggtgggagcagacgggggagtctgggagggtgggtagcaggtactggccacacacccgttggggacagggctggatggtggtctcgtggcctggccttagctccaggggaaggggtcctaggtgggcctggatggggtggggtggtgaggctcaaccccaggccttccgatgtggcagctcaggttccttctcacccacgccctgggatctgcgggcccttgtgtgggggctggcaggggtcatacagcaccggggactgccagttccaccagatgccaaagggaggcgtgggtcccagggtgccgccttccccacctaggaggcagatgccctgcggaatgccctggtgcccagcctggcctgtgctgctgcccacgccggtgacgtggaggcgctgcaggcgcttgtggagctggtgagcctcccccaccctgggggcccagccccagccacgcctggcctgggggctctgaaccctgtaggcaggacggcctttcatccacccactgaccacactaagcccttgtcagccagactgggcagcaggactgtcctgccagcttgtcaggtctcactgaggctttgagggtgggcgcaggggctgtgctgggccctaccctcagagggaccccaccctccccatggcctacctggccccgcctgggtctccctcaggggtcgcatgtccttgtgttactccagggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggtaatggagctagggctgcacagagctgccttggacaggtgggcgcagagaggctgtgggctcctgcactcaaacagcctcccggggctgggctgggagaggtggaggacacctgcttcctaaaggctgcccccgcagcccggggcccagtaagaccccggcccagagttcctagaaaacaaaaatgttgtggacaaagctgggaggacacggtgcatctctgtgcacctgtgggtatggggggctggggtggaggtggggcagaaggtcctggcccagcagccagacgcggtcaataaaaagcaggctacgtggcagcagatctggggctgtgacaggcaactcgggccctggaggacaggcccagcctgtgcgtgtgggggtcccctgccccaccaagcaagccctggctggtgtctcttcccaaagtccagagcagcagcagagacggagtgtgtgcctgtgcccctgcgtggggggcggggccagcactggtgggatctgcgtcccgtctccccttcctactctttattgccccagcctgggaaggccaacgacctgtctgctggtgccgctgcccggacccatgggctgctcagagatcccagggcccctggggattcctccctgtgggtgggaggacttggcctgcaggaccctgggttcttttcggggagggagtgctcaggagtcccatggagagaaggccggggtgtctgagcctggggtcatgtgaccctgacgtgttcagttgtgggttcccctccccagcggtgaagcggtgagccctggggtggggtgtggcaccttttgtgaagtgggtgactggggtagaaggttctttccagcctcctgtgatcattgacagggtgctcaaaagaataggagagaacagggtggtggacaggagggggcggggctgtgagggtccccccgagcagggctggggtgatccggactggagcttctagactgggcgtccttgggtgtgggtgggtggcgcggagacgagctcacacagtcccgccccctcgtctcctcctgactcacaggaccaggctcacagcacgcccccaaccggtctcccagcctcgctccgctgccaggctccctgaggccgcctgcctggccctgctgtgcctgagtggggtatggggaggccactgcctcatacctattcccaggctccctaaatggggtgatggggggatctgtggtgctttgcaggggtgggggcacggccagcgattatggcacagtctttaggtcaccctgtacaatgggctgtgtggcctccggcctcgggcctttgtgcctctgctcctccttgctagagccccgaccccacccccacagactccactgtccgggtgccctgcccccactcctacccaagggcagtcggccggattgattcagtgtcccctgcgcctggctgaggaggtcaccacggggtgtgatcagcgtttgggtgtgcagtggggccggtcagctcatgtaaggctgtcctctgaaatgggctgtccccttggaatgggttggggagactgccctgggaggagctattctgctagcaccaactaatgccctcccctgggtgctgggtgcggggctgccacagagttgaccccaccccttgcagacctcagctgccctaagaaggagtactggacaaatggaggtggtgggatcccgggatgatgtcacatgggcctaggcagaggatggggggatgggcccttgtctgaggctagggctgtggggtcttgggccggccggtccccgtccctgtgcacaggacatgagctctgctggctcctgagtgaggtgcagcggggctgggctggccagggcagaaggtcagcatgctcattctcacacaggcatccgggtgtcattgggttgctgcgggaagccggggcctccctgtccacccaggagctggaggaagcagggacggagctgtgcaggtgagtgcagctagagcacctgctcttccagggatgtgggggacacagcttggggaagcgaagccagacctgctgggagggacaagtgagtcagggtgtgggggctttcagaggcgaggcccgctgacctcagtgtgcaccaacctggctgatgggaagaggtgtctaccctggaccatgtcatggggcaggggaaggagttgttctcagctgagcgaacagtccagcaagggtgtctctgtgtgcacatgtgtgcatgtgtgtatgcatgtgtgtgggtgcatgtgtgtgtgtgtggtgggcttgaggaggggtatgggaattggttgtcgggtgtgagaggggctggggtgtggactggggggtggctggggctgcatttggggaggttggggcaggtggggcacagaggagctgaagcccctggcaggtgacaggtctcgtgagctctgttctccccagcgtggttcctgtcctgggataaactgacctaggccccgcctccacctgctggccgcatggcaccagtggccagtgtgccttccgatctcatgctgccgagtgaccaccgaggcaggctcaggccttctgacatcatgttgttgttggggagactgaggcgcagggaggccttcggcgagggtgtcggttgtgggtggaggtgggccagggatgcagggatcctcctctgtccgccacagccagaatcgctgccccccaccccatgccttgtgcctggtgacttggcgctgcctcctgtgcccagcctgggctgcccgaggccaggacgactccgagggacccaaaaaggagagtcggaggcaggagacctgggccgggtgcaggtggtggctggggtgggggtgctgtgagtggtggggtctgtgcgcctgtaagtccagagtcccaggcttggggagtgggtgatggcgggggctcggctcactggctgggagggggtgggtgcaggcgcctgcccagcaggaggaggactagcagctctggcttctcctctgggaccggcccacaacccctggtcttgcttttgaagggacttccggggtgacttggtcaagatttgcactccagacaggccttgctggctccattgacagatggggaaactgaggcagtagtcaggtcctgtgggagctgggaccagaaccctggtccaggactctgcttggaagtggcctggccagcctgagctgctggctggacttgagcccctcggctaggccttcctaggggccggtgtgtgtgtggggcttggcctcttggagcaggtccaggaggggccagtgaggccatccagcagattcgctgcagagattacccagtgccactgcagggctgctgctgtttcctgggtaggcgcagagtccctaagggccctccagaggagggggcagccccttcctcaccaggccacttcccccagcccctgcacaccatgggtgggtggagccttccctgccgggtccccacctggcctgctcctggcctccccaggtggcgagtgagttcttcccaggagggtggcagggtgaggaggagctggtgagggcctggcaggtgctccccactccagggcaggtgggcccagacccctgtcccagccaggacccccccatgcagtctgccggggtccagggccaaccgttatcctgggttgcctcctgtgtccccctctctgaaccactgggctgcctcaaactttccttccacctttgcggaccccgccccgggaagagcggtgtgttgtgtaacacgaaactggcgtgggctgctcggcaggtgggcgtgcatatgtgtgtgcaaaggcgcatgtgctcatgtgtgtgtgcacatatgctcgtgtgtgtgtgcatgtgtaggtgtgtgcttgtgtgctcctgtgtgtgtacatgtatgctgctgtgtatgctgctgtgtgtgcatgtgtgttcatgtatgtttgcgcatgtgtacccgacttgagtcgcagtcccacccactgggtgaaaccaggctccaggctgcccgatggcccccagtgactcctgccccaggaccaggtcgctgctgggtcagctgtttggggctggctttgtaagagcgtccaggccacctgggggacaggcacgtgggcagatggacaggtgcccagcaggccccaacaactcctcctctgcccccacccccaggctggcatacagggccgacctcgaaggcctgcaggtgtggtggcaggcaggggctgacctggggcagccgggctatgacgggcacagcgccctgcacgtcgtgagtgcccccaccccctgcaccctctccaaaggctgccacctccaggaaggacacctggacaattcaccagctcactgctctgcccctccccgctctgcccctcccccaaatgcctggccctccccatgcaggacccgcacagactgggtccccttcccggggctctgagtggtgggggtgacgagagtggaggagctgctggggccctgtgtgtgtgggctggggacaggggagggcatcctggggatggggatccttgggccaggctgctagtcagtggccccaaggcagcccctccccactgcttccccataggcagaggcagccgggaacctggcagtggtggcctttctacagagcctggagggtgcggttggtgcccaggccccatgcccagtaagtccccaccccaggcggggctgacaccccccagtgagcttctagtgcagggctggatcctggctcgggggggcgtaatcaaggggaacagaaccggaggaggctgagatgggtcccagccagtttagggtctgcagagcccctcctggggatgtccagggtggaacacagtttagaggtgaggagaaggagaaaggagcagtcagggagggcttcctgaaggaactgaccagacttgagcactgagggcccagccagggctcagcatccccttacccacccctgcccctgcgccctgccccaccgggaccccctaggctgggtgcttccgcttgtctcccaggccagttcccagctgacacccccattcccacttggttgtgtggccctcccatagtctcaagctgggtttgctcaggctcttgggctgtgccgtacagacggggtgcctgggcttgtctctctgccctgccttcgcactctacctgggtgtccttctcaggagccctcatgttttcaggaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctca

SEQ ID NO: 1307 - DNA, 87 bp, Homo sapiens
cgcgcgctgggtccagtggttcttaacagttcaacagttctgtagcgcaattgtgaaatgtttaggaccactagacccggcgggcgc

SEQ ID NO: 1308 - DNA, 10679 bp, Homo sapiens
tccaaacagttgaaggagaaacaatttaatcagaaccaggcctgagctacattaagctgattctcatttgagcgtatttgccatcagactgcactcacaccttaatccaactggcacaaattaggcctgaggcctcttccactcactaaatttgcatgaaggtgtctttgacaggtccagttcatctcggcaaagagcattcaggcccacccatgtccagcacccttggagggctcctggccaggagaagcgtcctcaggccagccacggccagcaagagccttcagaggccagcctggggtccggaattggacctgaagccagcgggccctgatcagtgctggcaggagccaggtgtctggtctcagccacccccacccggcacccctcatctgcctcatctccgtctggggcacatctgcagatttcaaggggcaaacccaattccagggttccccctccggccctcacgggccactgatgtgtccccacatgcctgcatttcagcaaatagcgtccctcagagtgggggccaccatcgccctccaccaagtctcctagggggcgggggacgcagcttatacaagggcagggtggcaaatctgaattcacaagtgggatcccctgcctccttccttggactctgtatcagcttccccctggctaggggactcctctaagcctccagctctgatctgaacaggcccacccagcgccagcaccaaagtccaaagcccttgtccctacactggacccccaggatctgatgcctggtttcgtttctggcaccacctccccccacacccccacacttcccaccccagaccccagggccttgccacttcctgattctaactcactgtggccatctcctccccaaacccacctacaaaagcccagctctcccccacctcctgcaggaagccttcccgactgctcccactgcctggtcccattgctaactaccttatccacacaggagcctgcctcctcctctggatgggggagagctcagcaaatgtccagcagtaaatggccccctcccagcattgcaagcctcccttcttgcccagagccccctacctgggcaattgcaaactgatcgtagaaggcggagttgtccacgcccagctccaagtcgatgtcctggagctcttcacagctaaaacagcaggacatagggtggagggtgaccaccaggacagccagtgcgggacatggctgagccgctggccagagagccaggagctttgccctacaattgttgggcgagggggtgggcagcagggagtctctggggacatcacggagggttagcctcgatgcctcctccatggagcaggacagcctttggggaaggaaacctccaggcccctccctgtcctggccctggacagccagaagacgccagctctgcctctgccctcctggaccctctgccccccatgccccacactctgaggatcacggggtctcagaggccaggcccctccctgtcctgacccaggacggccggaagacgccagctcagcctctgcttttctggaccctctgccccccatgccccacactctgagggtcacagggtctcagaggcaggagatgcagggctgcctcagccagacagagatggaggtggcatccccaccaacgctgcccagaagctctgcccccatcacggaggcatctgtggaagcagtgggcatcagagggcccaggagtgagccaggcctgggctcccggtaggtgtcctgcacccccaacataaaacgtgaagccaggacacattgacaggagcagggtgccagaaagagggggcccagcggccccaaatccctggaggggctgaagggctggaaacagtgtctgtgaggccaaggaaactttgcgtgtgtaccagaggttgcccacactcttgggaagcaggtggcccgagccagcaggcagagctgggacagtgcacgatgaggcacagggcacagctcagcacaggaggccctgcagggccacacacccaggtgctcctgctttcctctggtttgtgccccagctaccccagggtggaggcacggaacagacaggcagggagccccttcagctctgctgcatctgttgcagatgctggggtttcaggtctgggtttgcttaaaggaagaatgtggaaactctggagggttcctgtcttccagggttttggcctggggcactgcatggtgcccctcagggcggggcatcccactgtggggggcaggcagtcactgtgctccactctggggccccccacaagccagatgatgcccctgctaagatcccagagggaccaccatggctcaaaggcctccatccccaacccgcctgggagctgaccctcaccctgccagaagcttcctctgctcctgttcttcaccatccccgtcccttccaccatcttccaaactcctcaccatgaggaccaaagccctgagcctaatgctccctgggctctcccatgcagccagcacaggacagaagccccacagtctccggctgtgtggccacaccgagcctcccaggacccggggccatgctgcacgggatctgtcatctaagccctggtggcaagaacagggcagccagagtccctgaccacctggagccacccccagctgtatccagccctagggatgatcgctcttgtgtgacgtgtgatgctgccggctcctagggcgggaaggtgtctgacattgcagggtgggtctcagggaaggggctgcacaggtatgcacaggcaggggcacagtgcacagtgggaccagggaccgcagactcaggatgggcttcgtgagggaagatcacccacagcagggcagggtgtcaagggatcttccggggaggtgggcggaggccgaggcgggtggggcgggcgcacctgtggggtacggtgcccttctcggtgatggtgtcgcaccacatggtgaagcccacgctcacgatggtgctggcaatgaagaccaggaagaccacgaaggcgctgaccaggaggttcaggaaggcggagaagaaggagctgcagccagaaacaggaggggcaggctcactggacaccacctcccaggcgacccccgcccccaggctgcagccagaaacaggaggggcaggctcactggacgccatctcctgggcaacccccaccagcagcaccccccggaccctcaggattcctgggttgggccctgtggggcctcaaggagttgttccccctgcctgcggtccctcgggcagctccgtgtgcccaccctgggctgcaggtcacaccttcccaaagacccaggacctggaaccctggtccccaccatttcataaaagaggctgcacccagggtggaagtgaatgacacccttccaaagccgtccagccacagtcaccagcaactctggcccaggtgcttgtgtccccccaaatccatatgttccagtccactgaggggttagaaagtggggcctttgggaagagaggaggtcatgagggtgaagcctcatgaatgaaatgagtgccctcctaggagagaccccaccaagcgagctcccagcagataacgacacagcaagaggaacgggccctcagcaggcatcgaacctggatcccagcctggatcgcagacctctagcctccggaagtgtgagcagtaaatgcctgttgtttacaagaccccagcctgtgatgccgagagcttccattcacccgcaggtcatcagcgcgtggcctggacccctggtaggacttgcttgatgggccagctctgatttatccatttaaacttaaaaggccaggctgtgattgggcccatctgaccagggccagagcatggggagcgcaggaggcagggccatgaggaaggagctcacttagggctgggccacactgccccaggggtctgaggcctctgccagggcgcacacggccatggctttcagaggatgctcgtgtttcctcttctgaggataccgggcaggtggtcgggacacccaccccacccggccctcctgcctggcctgcaaacgtccatcatctctgaattgctccatcaagattcaaagtccctcgaatgggcctggggtgggctcagcctggaatgcacacggaggctccggggggtagggagagggggtagggatagggactgtccctccagtgggagccctgagggggacttcctcacgggcggacaccagcactagcagcatggctgagaaggggctgctcccgcctctcacctgccagcaggctcgatgttagcctgcatgctgtcagcacactggatctaagggaggtgacccacagaaacagcttcacagcgatcatttaataaacaaggtctccctggaatctcagccaagaaaacatcaacgctaccgtcatccgaactcggcagctgctgatgaggcaaagtggaggccagcgcattgtctgttcattcattcagcaggcactttctgagcacctgctcgccctgtgctggacacagagggcagagtgatacaaaagacgaagtcctggccccgggaggtgccccagccaacgtgctgaggataaacccaggccacagcgcccaactcagagcaggcgacaccaggctgctttgtaacatctggtgcctccaaggagcccgtccactggccccagtcccggacacactgttttggtgactgctgggctgacagcagaaccaccccccaggaacgggagggtttgagccaccccagggagtcccagacaaggggagaggacacagggacactcttaaagccatgggctgtgatccaacaaccacaccaacgagggcaggaccagcaggactcacacacgtacgcgtggggggtgaccgagcctctgcccaggcctcatggctgaagatggctggagagtgggtaccgtgtgccagtagacaagccacaacccccatcacagcgccacatccaaagctctctgaagacagaaagagcagcggcaaaagttcgccaggatgggtgtggggccattctcggtccctctccagcccagtgtgctgtgagtctcagagctgtcacacatgggactggctccatccgccctgcccaagcctgaatcaccatgtgccagtgtctcccgcctgctcttcagagtgcgtctccttctccattctctgtctggaggctgaaaggtgtggaccatggcaatggccccgtgccctctggcttccggctgggtttgggcaatggggtgggagggcgggagagcaaggtgggaatttgctaccaggtccctccactgaaagtcactgctcctctccaggtgacccacccatccaggtcccgttagccagggatggggacagcaccacctccactgaccccatgaaccccaccacttcatctcttgtcaaccagccctccttcaatgacctttccttgggtgagccatctgctgctgctgggaccctgaggacacagttctgaaccccaaaatccatctggcctgggggtgcaaatgaggggctaggggcctatagtcacagagcggaacgcagtaagcccgccccacctctgcagtcttggaccagctgctccgccccagccaaggagaaggtggtggcgaggcacggccagggtcagctccacagccagaggcaaggaaggggccactgccatggtccacacctttcagcctccagagagagaatggagaaggagacgcactctgaagagcagggtctttcagaccctgaaagaccctggtgcctgcaaatacctggcccagtgcacctgagatacggcagaggctctgggcccaggcgacccactgtccccttcccaccactgagcatgggccacaacacaacctccaacagacagaaaagccaattatctggagacttcaaacatccagcctcacccctatgaaatggcccgattttggagtcttctcccatgaccagatcgaggagttccccatgagatagggaagggaccccaggctggggccgctgccagctgacagcctcggtctgttcctctcattcctttctggtcggtttccagggatcctgcccaggctgtccaggtcgttgaagaattggatgtgtccagagcatccccggatccagctccccagaggtcacagggccacccagcccctccctcaccaaggccaggccaggacagtggtcaggaacaggagcccggcacatgcagggttaaccctgtctctcttcactgccgctcagggtgccctgccaggatgtgccatctccatggtgaccgctgtcctggaaagcccagcaatgtgaaggctcagcgccggcacgggcaggcagatgagtttaacgcagcatccctccggcccgccaaccacaaactgctgccagcccacgtgctcaatcctccctcagcacagctgccccaggcccacggctgcctcagcaaacccttctgccccgaaatggcaagcctctctgaagcacaggtgccattccattcattcatccattcattcattcattcattcattcatttactcattcattcattcattcattcattcactcattcactcagcagccaataatggagcatcaagatgacactcctctgcaaaaagctacccccagactaattttcacacttctgggcacgagctctcagggcccagactctgcatgaaagacacccccataggaagaggaagctggcacctgagacatggcctctgctccacaagctctggacgtgccatgtgcccctcaaacagacctcacacaggccttgccctcacactggcaggagggcagccgggtggcccctggaggtggagtcccctttagagggttagagcatgtgctgtcctaaacaggcccagacctctagcagccagagtctgatggggtcagtgggctcctccctgggctggacgtccagtggccgtcgatggccctgagagcccttgtccaccacatgagctccctgtaaaggcccgtctcagctccgtggctggtcctgagtcccctttacctacctggcacttgctcacctagtctatgcagctggaccaacaattgagttggaattggctgctctgtcgctggaccctgcagaccccatcttcccaggggtccagaacttcctgacatggcaagtctgaagggtggacctgttggccagataactgagtctgcacaggtatcggggccaggtgagtgaccacaaggcagcaggcctcaggacccaggcatctttctgtcagtcattcaacaaacattatctggggactcctacgcaccatcccctgtgctcagccctaaggacacagagatgaataaggtgcatgtctgccttggcttcacccagctgtgggtcccctagggtggggtcccctggggggggacccatggcctgagatggctcttgagagcgttaaccttcgcctacaaccagaactcaatggagtgctgacacgtttgacagatgtcaccccacaagccgtctgccaatggactgtgcagtgcatgaggtgggggacaggtggccacatgaccacgtgaactgagccactaattcctgatggtcaagaaggacacaggcaccagatgtccctggaaaagagcaggctgggcggaggtcagtggtgggaggattggtgaacccctgaactgaagcaaaggagctgaacctgaaatgctccgccacaggccccttcctgacagcaggagctgcccggacctgacctccagtggggtcaaggccatggtgagcctccacaatgtagcccccctcgacaaccctaaccctcaccctaacccccacaggcctgagcataccaggccgtctaaggcttcctaaatcccatatgggccggtcagcagggctgcagcagaggccacacagctggcctgcatcccagccggctccaccccttgggaggatggaacaccacaaagagtgctgggaaggcctgcagactccccaggaatctgttttctgcctttggaaggagatggtgctggcagtttgccacggctgacagacagtcaccttccgtgagatggcaagaggcagagctgctgttacggcatccctgggcctgccgcccagtgtgtgcgaaatagaccataccctgtgcgacctggactcctgtcttgcaagctctggggctcttttctcccctctccctgtcccccagcttctggtggaaccccctataaaatctcccatcactctgaccacatagctgggtcctatctagagagccaccctctgtcagccccagctggaccacaggcaccctgagggacacccaggaggtgaagaagtgcgtgagcgatgaaccaactgtggccccacctggcctgcaccctccaccctcagcttcccagactaaagggacctcaagcgttgggaggctgaccctactcgctggctgtcccactccctcttcacacctgtctcattcagggaggcttccacctgcctgccctgcatgcacagcatggactgggcaactcttgggtttggcaacatgggtgcagatgacgtctcaagcctcttcttgggacaccagccctggagtgggctgagggaaggaggacggctgcaaatgggcaggacaccaccctgcgcccggcctgaccccaccttgagcagggctccagccacacaatttgggcccatggccccacagtacctgggtcctcccaggctgacagccagctttctactgacccccatccagaaccttagtgtcgtgggttgaatggtgtcccccgaaagatatgcccaagtcccacccctggtacccgtgactgtgactttgtttggaaatagcatctttgcaggtgtaattaagctctggatctcaggatatctccctgagtttagagtgggccctgaatccagtgactggtgtccctgtaaaaagagggaggacagagcagagcaaaggcgccctgtgaggacagcggcagagggtggtgggacaagtgggtttcagtccagttggtgcaactgtgctgcagcagccccagggcgctcctacccacaggcgctgggattctcattcctcctccagagtttgcagccccactcagcatagccctggctccctcccttctccctgaagcccctcttcttcccctctctggcccctctctcagccaaaaccaagcggtgggctcacagcgggggcaacaggagggcttccccactcctgccgcccacacccctctgagcccttctcatctcccacctgcgtgcaggaagtgaaaacctacaacaaaggatgggggtgagggcagagtttgggaggagcctgggtttcatgagtgctctcccggaacctctacaggatctcgggctgctcctgggcacagcaggcctcagccaggggagtgggagggcccacagagggcacccacagagggagtgggtgggttcacagagggagtgggtgggctcacagagggggtgggtgggctcacagagggggtgggtgggttcacagagggggtgggtggattcacagaggtggtagatgggctcacagagggcacccacagagggagagggtgggttcacagagggagtgggtgggctcacagagggagtgggagggttcacagagagcacctgcagagggagtgggtgggcccccagagggcccccagggtgccactggctaagggtgtcaccgcaccccaggtgaaccaggttgtatgggctccagtatctagccggagcaggaaagagaaagaggaaaatgcaggccaggaggaggaaggcgctgagcccacaaggcacagccctcgccctgcagtctctctccagctccccatccaaggcctgagctcgaggtgggcctgggtggctcccctccagacagccatctgccgtccctttcccggggcgatggtgccgggtggggctccccagttcgccttgtcactgggacctggagagctcagtgcaagccctagaccgggctgggagttgtcgccggtcctggcgagtgtggcccggctgagcccgcccaggaaggtccaggcctgctgggtgatgacagtgcaacatctgcaacccaagggagcagatgcccggaagcgggaggtgatgcgcagctggggaggggaggcactggccttgtacgcaggaccggtggtcgtcatggtccctggatgtgtgtgtagacaaagggcggtctgagtggagggggtgagggcggattgttgacatttgcgggcctcggagctgcctgagagacggagggactcgcgcgcctccccggggaggtgggtctgggggcgctgggggcatggaaggggcgccgcgccgggagcggcccccacttacccctcgtgtcccttgcagaggaagaagagcgtgcgccaggcgtgcgcggcggccagcagcagagacaggaggctggcgagcaggctgaagcggcaggcggccggcgggccccactcctgcaccgtgaagcgctcgcgctcctgcaccgtgaggttggcgctcagccacatgccctcggtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagc

SEQ ID NO: 1309 - DNA, 10129 bp, Homo sapiens
ccagctttgcgatccagcagagagggctggagacgggacgaaggccacaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggtgagttccagccccagggagagggggctcacttcctgcttgggtatgaagatgccagagcggagagattgccaaaggcaggtgcaggtggggaacctgccccagctgggcagcaggtgtgggcagagactgggcagagcggagagattgccaaaggcaggtgcaggtggggaacctgccccagctgggcagcaggtgtgggcagagactgggcagagcacacactgatgatcctgagtgacctgaacaagctccagagtggccacccttcccccttctcctgggactgatggtttccctaaaacggagacagtcccaggccggccctgtgtccacactgaggccaggccgcctctgggggaagcagggaacacggccacttcaaacttagcagcgggggtgctcctggccacacaggagcttccaaagggcacctgatgttgcgcgaaacagcctgggcagtgggagaaggggctgcactctcaggggaatgcaggcagccgtgccaggcatgaacccagccagccttccctgaagggccttggtggggggcatcctccgagggcaagtctacgcaggcccagcctagcaggaatggattcgttactccagtaactgaagcctagttctcagtgtttgggaatccctgagaactggctcttttctgagccgtcagtcagaaggaatccctgtcctgccctgtgtggccatgggacccccacccagcactggacgccacgccatttcttgggcactactgagctttgcagtgccctggacagttggcaaacagcccccattccacatatgggaggaagggcctgggggggtcccccgccctgtctgtctggagctctcgaggcctagggtggcccctgcacccagcagatgagcagccatcacccggtactgctgctacctcgagccctaactgcacctcgggatgtgagggcccatctaggcatggagaggggcctcagggggccaccaggcagctcctgctcctgttcctacctggtagggcctgcaggcacctgagcaagcccagtgggcggtcagcccagccaggggcctccccacaagttctccctcttacttaagtcgagaacgcatgttgtctggggagctgccagcgtggttccagtggtgagcgttgggctgggagccaaggcttttcccaggagcccagccaccccgcctggctgtgttctgcctccgccctgcagaggaaaggccagcgaggcagtgtccatggtcccagtcttcttccaccggaagaaggcacaacctgcatctgcagccccagggccattgggttaggcctgtggccaaactactaaggtgctgggagactgaggaggcccagctcctcctggggccaccaagcccgtggttgacggcctccccatggaccgggctgtcccgagagcagcaagtcagccggggccctcagggccgctgaggccactgctcagtgtcgccgtaatggaaacttctcagctggttgtgagccgcaacagctctggttcacaccctgcgacagcgaggctgtgaccgccagtggatctcggggctgatcaggcctgagccaccccggaggtacagcaccagcaggagcccaggtgggcaggggcagagagagagagagagagagagagagagtatgtatgtgtgtgtgtgtaagtggtgggggtgggggctgtgagtctccagcttctcccagggaggtctctggcttcccaggagcctggccccctgtctccagctcccaagtgagttgccctgggggaggctgcacctggaacagggaaacagggagcctggccccagcctgcactcgctcaggccccgggaccctctgcccctggaaggctgtgaggctgccgtgtgaatgggtgcagtgccaggcgaggggtgagccgggagtgtggggccgcacgctcagagccgaggaagggcagtgccaggcgaggggtgagccgggagtgtggggccgcacgctcagagccgaggaaggacctcccatgtggggtgggtgggatgtcaggatttctcacgagccagctgctgcatggggggcactgcccgccccgaggaaccctcagggaggacagagaaacatcaggaggtgggctgtgggcaaaagggcgggcggcacgggccaggcagaggcagcagcctgggaggaggcgggaagccagcgggcggcgtcctggaggacggggcaggagtgggagggagcagcagtggctgggccccagagcttggcgttatccaagccacagaaccaggcaagaaccactggcccgcccccacgccccactgcaggctggtctcgagggggagggactcggcactgccacggccgctgggctccatcagtgccctcacgtctctcagcagcttcaagatgaggtggggtctttggggtactgggctagacccccaaagactgttggagggtcacaccccagaccaaggtcctgggcctcagccctcatggccccacctcccaccagcagtacgggctggtcatgcccacaactgggagctccgggccctgactcccgcctctgtcccaacccaggctctgaaacctggcaggctgttctccctctctgggcctcagtttcccctccgccagggagctcggtgccccctctcagtagaggagctggtaagaaccccccagccccccagcaccaagggaggcgccatggggttcctgttcccagagtgggggtagagtcccctcgggtggacgcgccctccccagcagcgggcctagcgggacacttacaggtccaggctctgaagctattttccgccctttatctcccatctgtcacgaggcctccagttacacactgtccctgccagaggccccaggcctccccgcccccacctgccgagcatgccagagccactccttccctgcttccactggggaaaatgaggcccagggaggtcacaccacttacccgaggtcacagagccaaagaaggacagagcccaggacttgagccagacctctcttccagaaggggaagcgtgaagcccagttagggaggggatggcagggctcagggaggctgtctgggagcagagcatggcccacgtgaaggtgcatctctggagaggggaccgcggagctcagggaggctgcctgggagcagagcgtggcccacgtgaaggtgcatctctggagaggggacctcagggctcagggaggctgcctgggagcagagcgtggcccaggggaaggtgcatctctggagagggccccagggctcccggaggggaggtgtcatcccataggatgtcctgactgtccagacacagccagagccacctgagctctgttcctgggcacattccctccccgagtgatgccaacagtggctgatggcacagagcacaggcttggtgcggactcgggtctgtgcactgactcccaccctcacgcgagcccgcagaggctgctgctctcctcacccccatttcacagctgagcagaccaacgcccaggcagattaggagacttgcctaaggtcacacgtggtcacacaaggtgctctggagcccacacctgaagagggggaggtgctgtcccgtaggaagtcctgactgtccacattccggcagaactctgtgccccagaaggcgaagtcgcgtcctccccaagttatgctgctcagcaacagatggttaatgccacagccaggcaccctcacaaacacactgcctacgcctgcacattcacatacactctacacaaacacacacacattcacccacacatacgcagatacactcacacacacacacgggcacatgcatggacacacacacacatgcatattcacatgcacgcacagaaatacaagtacacatatgcacacatagccacacctccatgcacacattcacacacacagacaccccacacgtgcacactcatgccctctgacacacgtgcccactctcacacttgcacactcaggggaatactcacacatgtgtgcactcacacacgtgcacacacacactgttttcccaccatcccttggacagaccccaggccaaggaggggtgaatagcgagagctgctggcaggagctgggggagactgcgtccagccctgcatccctgcgtgactccgtcggcccaagcctctccaggcctgtttccccatgaggagtgaacctggctgggccccctggaatgctgctgcagggtcgcctggcaaggggctgtggccctgggcacgccagccagccccaggccgtgcagccccaggaaatgaccccgaatgcacaagcctccttccgccgggcagtgggagagcccgggctctgggtccaagaggtcactggggggctctgctccacccccaaccccaccctgggctttagcagagtttctatcccacccagggtggaaactgagtcaatggcatccagagagcccttccagccccagccctgctacggacaggcagtcaaggttgccctgccaggcagcatccccaaaacaccaggacaggcctggcactctgtggcttccctaaccctggggatcacgcagagcccacattccaggtgacctggccccaggagacggggccccagctcagctgggcctgcaagcacaacctctcccacagccactctctgagagcaggtcctgaagataagccgcccctccccgccacccccctggatggccggctcctgccacaaccctatttgcaataaaaacctgatccggcgatagcagaaaattgctctcttttgaaataattgaacccgtccagacagtgtcctcccagacatcattaacagggcactctgcttgtctgcagtatttatgcccacttggggaggtggtcatggccaccctgttatctcctgtagaggacggcacacggctgctggagtcactgcagtatccacccaaaccactcctcccacaggcctgccctgaacctctgaggcacccatccctttgggggaccctggaggagttatccttgaggaccatgtaggcccctcactctcaccctcccccttctcagcccttgggggcagggtccttggaggaccacggggagccagggaagcatctcaggaaatgcaaacacctgccctgtgaggggcaggggcggcagtaccctccaaggaccccagggcaggggagaacctgaagggcagcaggaggtccccacactgccccctatccagctgggagcagggcagggaggacctggcctggcatcagctcccagggaagccccagccccctctggcctcagtttcccgacctgaagcaagagaggcaggctcatcacccccagagcccttgaaaggcagacacctgcacctgcacagatgcctggtaggcactgcacccctctgtagggaggagtgcccaaaagtcaagaaccctgccaaggctgtgagagaaaattcacacttggggggctccaccggtgagcacgaatgaggagagcacagcctctgccgccaaagacacgggggtggaggcgaggaggcgccattcacagccaggaagcaaccagcgcaacagaggaggggacagagagacagagatagaggtagagagatagagagagaatcagagagaggaagggggacagagacagaaacagggagatagagacagaattagagagaggcagggagacagagatggagacagagagagagacatagaaagatagagacagaatcagagagaggcagggggacagagagatggagacagagagatagagacacagaatcggcgggggcgcggtgcagagagagacacagagagagagtgtgagccgtgctgaggggtgggcccccaggagcccaggggcgccccaccagcaccagcccaaaaaggtgggcatgaccctctgggaagcctttctgtggacccggtctcagagccctgacaattcccagtccccagccccagggcttcccgctaccgaaaggagacaaagcaaagatgtttcttgcagccttatccatgacctccaaacattgcaaatgacaatactaaaatgcaaccctcatgaatacccaatcatcgagggtgactttcagtgacgggacctcggcccagtggaatattatgcagccattaaagatgataattatgaagaccgtggcagcaaaggaaattgcttgcgatggcatttctgaacgagcagggaacaggatttacctgcactggggacaccacagaggaaaagtggtgtctgctcaacagcgtggccggtcgcaagcccgggaagccagcctggcttccaggaaagaattttctcctcctcttattttcattcctctgagtgccacttgtgcagtaaataataaataacgtctctgcttatcttaggaccatgttccagtaaatgaggactgcagcaggagccgtgagccctgactcccggccagagacacgacgtcagaccagaaagaatgaggaggccgcgtggggcccgcgggtgtgcagggcagagagggtaaggcgggccgctgggacacagcttctgcaagctggccttccactgggggctggagggggcagggagcaacagacgtggaaaggccatcctccaccccaggaatcagggggtgataggaggagggcagggggatcactgagggctggggggagcagcggggggcaatgggtgccttgaaggatttggtctggcagaggagattggaggcccccaggtggggcacagcttggcagaggaagtgggagccatggagggctgtggaagaggcagctcagggaggagggtgttggaggagggaagagggtggagagaggacaggtcaagactgtcaccaagggtcagtgttagggttaggggcccagacctcagaccctgaggctccatccagcctctgaggcactgccaggctggggcatgccacaggcacagcaggagctgggccagactcagcatgggcaggcctcacgccctcgcggggcagcctcgccagatgccgagcagcaggctgtgtacagcgagcaatgccccagccaggaacaacctcagagctggcccggctcccagggtgcctcagccccagttgtcaccatgtcacagacaaggatgctgaggttcacagcagcccgaaactcccactccatcttccagactcaggctgggcccatacacgtgagcagaccagcagagaaagggcccaggtaggcaaatgtgtaggagctgcccccgcctgcagcctgggaggctcggccccagggaaaaggaggccgaggccaccaaccagccctcctcacggccctggcccggcccctgccccatagagcttgcaaactctggccccttagccagagcccctctgccattgcagccccctccccctgtccacatgtcctggggaccctgtccagcagcctgcatccgagacagcgggcagacgaagagaggttcagtggggacttgcgtgaagagacggggtcaggaggggctcctgtcttgcctgggcccctgaggctgagtctggctgccctgcagtccctgtccaggagctgcccctcaccctacaggaagtgacaggcccagcatagcgcaccagccaggacagggtacaggttccaggacggtgctgctgggccccacatggctcagacctgggtaccagcggcctcccgccggggactcaccagtctgcttcccgcccccacaccaggaggacaacaggaagtgccccccctccatcctgaaacggagccggccggagcaccaccgcccagaggccaagccccagaggacctcgaggcgcgtgtggttccgagaacccccagcggtgaccgtccactgtaagagggcacccgcagcaagcagctgggagagggtggagtcaagcagagggaggcggggacaccggccacacccacacagctctggcagggcccaggacatgggggggccgtggccacctgccttcagtgccacaacccctgtaagacctgggcccctggggtcatctggacacacagtcccggtccatgaaacagcaactggaggagaacatgagggcggattctcaaatcatgactgtccctttgaggaagtgtcaggaccggctgggcctgggtctctcactgatgaatagtctcagggtccttcgggggtgcagggtgagacgagagggcgggggcgcccgatggactgaggcaggtgcccccagctgactctccattctctttcgcagacattgctgacaagaacgccacagccactgtcaggggtgagttctgagcccacatccctgtgccccactgccccctccgtgggtgcacccaccctcactccctccccgagggaggtgtcacagggccagggcctctaaggagtccccagttggggagctcttgttgcaaggagaccccaagaggctagggaggggccatgggcatggacagggtggaatctccccatcccttccccaccagccccagtcctccagggaagggtcgcgctggctggcgctgaccctgcctgccctctggccgcagtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttc

SEQ ID NO: 1310 - DNA, 30006 bp, Homo sapiens
ccgccccgcgcccgccaggagccaccgtccgagccttgcggagcgcggcagtgggcgccggctgcccgcagcccctgacccggccccggacggagcgccggccgcaccaccgccctctggccgttgcctcaccgggtaagtccttggcctcggggtccgcttggagcttcaggggaaactgagtccgggaggaggcaggggcgtgcttgggtccaggagcgaggttccgggctgcggcgtgtgtgcccaggtggcggcgggcggtccggcggcgcagggtacagttcccgggcggggaccccagggcgcccctggcccccccggctccgcgcgccccgctcgggactatggtcctccgcgccgaggcaccgcccgagcgcgcactggccgcagagtggtgggcccagggtcggccgggcctactcccagggcaggcgggatttccgcgcctcgcggctgccacatcctgaccatgaatcagccacagttgggaaaataaacttcaacttcgggtccgccgcccgggtggcaccccgaggtgcgcgccggcctgcggccccaccctgactgcttggcttccagctgcccacgcgcaggtgggcgcacagggagcccttcccaccccgcaaccgctggcaggcttaggggaatcagcctccatcacagctctctgttccttttgggtggggtaggatccaatccctgtacgcccccagacccacccgtcaaccctctaactggggagtcgccccaggagtgaccatgactaaggaggggaaggcggggtgaccagctgtgtccctgaccgtccccaatgccccctggggagcacaggcgtggggggtggtctgtctgtctgggccttctggggctcaagctccccacccagggctcccgcagctcagctgtgaccacagcattactgcccactccagctggacacaccaggaggcagagaggcagagaccctgcccaggcagggaaccaggaacccaggaaccgggccagaggtcaggcacacccagaaggcgctggacgtaggaaattcccttactgccagccctgcccctccgtctggcactggaatggagcaggatactcgccctcttccggcctcagtttccacatctgcactctgaagggtgggacagcagctcaggctgggacctgctccctgccgccctgcactgggaaggtggggtcccagagcagtgcctcagaccccgagggtgccacccagccaggggcttttggggtgtcggtgctcagcccccagtgcagcaaatagtagcattgggttccaggcctggggtctgagacctcacactgctcccacccctaccagggcagcagcaattttctgttctaaaagccaggttggtgcagtgggccctgcccaggccctgccctcccatccctggactgtcatgggccctgcagcccggcaaaggggatgtcgctagtggggacggaccaagtggccaggtgcgactgtagcctccacagccagggctcctgagttaaccttcaggtgagcgcccactttgtggaggagctgacggctgtcaagcgaatgacacacaccgcacatgtggggacgtggaagctcctacctgaaatagactctgcgccttccatcaaagtgcagttacttcctgggttggaaaagttatgcggttcatgcaggctgcgggaggggtgggtggtgactggaaagtgatgcggtgctgcctgtgggtgtggggcaggacgcagctggcccagctctggacggggacagtgaagtaagctcaagcccctggctttttgctggtgcctggaggtcaaatttccctgtagtcaggaatgagacctgactccctgctgccagcccctcccctacctccatcttgcaaacagcaggtgtctgataggtgtgtggttcatggcccagtggacacattacattggagaaggcacacccacctctgttttcaggatggtggacgggaaggccgggaggtggaggccacataggagccagtctctggagggtggtccccaggggccacagcagacccaggcctagtggacacctaaagtcaaagactaagttctaccaacggtgggaaggagagagggcaggggcacgggctccccgtcgctggaggggtgagcagggtccaaccacctggccccctgttagagaggcttccactcctgccagcctcaccctaggagggagagtcctgcctggtctgcctctgagcacccagacagcctgggtcctgagctggggtgaggtctgctcacacagctgccccccagcccagtgccggtataccctggcaaccaccaggccaggagagcagggcagaccggtggtgcctgtcctctcctgaggggccgtcctctctcacagccctttctaagctgtaattaaataaggaaccacaggggttgcttagggtcgcccctctgagggctcatgtcagtccccgagggccagcctcaggccgggtctgtccactcaccattcacgccagcctgggcagggtctgtgtgctgggtgagtgggtgaggaggaaaggaatgagccagcctgcggggtccctccgcacggtctcccaccctcatccctcccagtgcgacgtgggtcctgcaggagcgttcatttcacaggtgaggcgcgggacagtcggtgccattttacactcagtgccatccattctgccaggaggtgctgataaagcccctactgtgtgcatctgcccttgtgcccagagcctggagcccagccccgctcagcacggtgccaggcaggtgcagggcacttactgggggtcagggtgcaaatgggctggccccacagagtagctggaggccgaggccccccagcccttgttgctaccactggggtaggctcagggtgctggcactgccactctgggaataggacaggcctgtcctggtcaagtagccattaccgggcctccaaactcgggggttggtggggcaggaataggcccgccctccaggcaaccacctgtgtcactccagagcagcccatgcagacagacaactgcccaagggccagcctggaccccggagccctcccagccagtcggcctgggtcacagcctgggtggaatgaccagtgtggtcacagcccagatgggatgactagcgtgaaggccctgaggaccttgccacgccaatggccaagggcaagggccaaggctgctttcctctttcgcctgcagcttttcccagaggcagcagggagggagagagaggtaccaggagagtcctgagagaagggccagcctgggctgccccgagcctctgtgccctcagttcactcctgttctcaccccagaagggtgactggccgtggctggggcaccctccatctccctcagccccaacctctgtctgttggaaatggcatggagacccagaaggagcagatgggcaccactggaggcctggccaggctcctggccgccgatcaaggcctttgcagggtcagagggacatgggaagatgctgccaaggcccctggccctggtgccctgggcagggaccctgtgctcccgtgctgtgacagcgttataccaccccacctgcttcctgtgacctggacacagtctgagcaccccaaggtccaaagtgggagaggtggggtgggggagagggagtggggtggattggagggctgtcctactgttacagggctctgccccgggcccacctcacagtgaaggcagaggcccccaggcagcccttggtgggccagaactcaaccaggagccacactgggggcggagggcaggctgtctgcttcccattttgcagacgagggctagtgtcaaagcctagctttgaggctaacccagggcacagttgaggagggagggagagggaagcagtggccgctgagcacaccagccccgggtagtggcttttctgtatcatctccaagcccccattcagctgctgtgggcagaggccagccccagcccctcgctctgcccagcgagtggccagctgcccaacacgcatggagtcccagtgggcatggccagtggtgcaggggtttgttcgtgcctgagctgtcctggccctcgccgggtcgggggtggacgtggccagctgtgcgaggagggccagcatcccactggcctccatctccccatctgtacctgggtccttgcaggccctgggacatggcctcggtgtacagcctgcctgccccaccctctgtgcccccgggtccctgttcctgctccaggcacagctcagactgtcgcctgcacccagcctacgctgggaggaggacacagggtgggggtgagggagtagccacctgtccccacctgcctctgcttccaccttgtgcacagacatgagtggcctgagaacgggagccccttggggacacccagggcccctgcctatgcttccatgtgcagagggcccccccggctgccccttccctgggccaggccaggctgtggaggtgcaggcccaacagtgaggggctgcctgcaggagctggcagagccatgggccggacccaggaggggccacacgggcggtgctggcacagccaacccaggtcagagctacggggccctggagaacatcctggccattttacagatgagaaaactgagtccagaatgggcctggctgtcccaggcccctggcaccctcgtgtcccagcaagcattgccaagcggcatgttgcacccacgctgaggatcttgtttgcccagttgggcctgacgggctccctggcactggctgcctggagcagaggtcaagagacgctgagcaggggctgggaagattcatgcaacgtcctagctccgtcccagccgccaaacaggaggtgggctgagtgggaaggcgggcggtcagtgcgtggttatgcactggcattacaggtggcatctcgtcaatctgtcagtaagctgtgggggtggcattgacacactcatccgcatttgaggacaggaaccaggagatcctatgggtcacaggccggtcagcggaagagcccagtctcaccctgaatcagagccgtcccccaccctgggccctggtagcagcccctggccgtgctgggtgcgcaggctcagcctctcccccactctcaatctgtctttgttctccctgctcctgggaaggcagctgctagcggggatgtaggctgggggcagggaccatggagcctggctcgtgggcaggcagcgggcagccgtcttgtcttggcacaggcagggtgggggctggacaccctggggcccagctaggcacacagcaatcaggacctgaaccctgaagccggggcctggctccaatgagctgctgcccttccccctcccaggttgagagaggctttttctgaggacagaggagggacctggggcctcggaggaggcatctctgagtatgtctggtccggggggaggaaacccaggtgggaggattctggtgacgagctcctggccacctgccctcattgcccagcagaccccctgcagggtacgtctggggcctgcgataggccagccctgggctcatgccacctgcagggcctgatcaggccctgtgcccttcccagtccctaaccacagatctgtacacgtcactcccagccacagccatggtaggtgctggcaggccctcaggcccaggaagtacttccatgtagccgctcgtccccccatgcctctccctgggcccccagactccagcccagacccctgagaacgccagaggtgaccaggccctcagggagcaccccgttggccctgctgtttgtgcagtggagacactgtggcctgtagaaggcccattcggtgactggcgagccgcccacccacccaggccctgcacaccctcagtgcaggtggaagcgagagctgggcttcctggcgtggggcctccgcccttcctgtcctcccttgcctgggctgcgcttgccgactctcctcccagtgacccctcctcccagtgagccggggcatttcctgtttgctgcatccccctaccccccctacagagtcaccctcctccctgtggcttccacagggctctgttcctaacccaggaagatgtaccttccccaggcccattgtctgccccagatcctggggacacagagagcccagctgtagcctggctcccgggccagtggtgtcccctggcgttcagtgctggccagcccggaccccccagccacctccaccgacacttgccagagtgccatgaaggacccctggcccccagctctgctctctgggtgacccaagcaggggctaccaccgctctgagcccagcttccctctgtgagatgttgctgtcttttgatcattttgcttgctttcttcctcagtatgaaacgaccatattcatccgagatgcagcttcagttagtgattgggcaggtgtcccggtggtatcgcacccaccatgtgattgaaatccgtcaccatgcggcctgcttcccatctttgtcttctgatcatgatgctgctgagagcgcctttctgcccacctgctcccagggggcccttctgtcctgctgtgggtcctcacagtggcccgggggccctctttgcacaacaagcggagttcaagatcttggagggctttggaggcaggagccttgcactccatccagatcttggggactgcaggtggcatgagggctggagtgcttcttgggtgtgagacgggccaggtgacagtgaggacacagccagccctcaccaaggcccagtgcgccccatgcccctggacacgtggcagtgggtggacccccatcctcacctgccttgaggccccctgtgcacagaccctccctgggccttgccggcagttggtgagccaccaggtcagtagaggtccctcaaggggctgttggcctggtggggaaggtgacacatgctggaggctcaaaggagctgggagtctgagtgtgagggaggggaatgggggtcatggtagggcaggttcagctccaggtgcctccaccgccctgcagggcctgggctgcccagaaccccggggtgctgccaggaacgcgtgcagtcctggagatccatgggttgccaagcagtggaaaaattggggctctcggaggagctaaaaatacagtgtggcagcccctgcctcctagttccggaatcctctcctgccgttctgcccacccaccccgtggaagacaagctccctccctgcacccccaccaccaacgctggctcagggcccagaagcacccagccctgtgccagtgccagaagggcgacaccacagctgcctgcccactcccaggcagcagccccccacaggtgctcatgtgcccagccagtgcctgccctacccccgccactgcttcagggtccccagagccccttggtcccaggcacagtaggcagtacctgccaccccagggctgccaggctcagggcttggcctgttcctcgtggggagcctggacccaggcagacctctcccttccctaccagtggggacttcacaggggagggggctgtcccaggcagactcagaacatgtcacagcgggggcctccaggcccattggtgctggccgagggcataggagctcccacactgtgctgtggaaggccctcctcgcctggctcctgggaggcaagtgagggagccgaggcctgggggcttcagtggctggctcaggtccctcgcgtgctgggattcaagtctgggtaccctaaccctggcctgtgtgccgctcagaaccatgggcccatgcaggagcccccagctactctccacagctcggtgctgggcctgcctcaggagcccacactccctggctctggttttctgtctgcaccgcaggggctaggcacatggctgcaggtctagtgaaggccagcatggccctgtccccacccacaccacacactcagcttgactgttgactgctaggcggggcggtggcccggtggcttcccgagagtcagtgcagctgccctagcatgtaggcattcggatggaggtgctggcatcaccacaccaggctggccaggcccaggcccagagggggaccctgcctgccagagctagagtcaggggagaggcatggccccgtcctctggaagccccaggctattggttgacaaaagcaagtgctgaagaaccatggtgatgtcccactagcatgggtggggtgagcccctcagacctcagagtcttcatctgcaaaagaccctgccctgtgcagttccattggtgctggtggactgccggggggggtggatgggacgccccttcttggtgccctgacccttttgctgtccaaggcatggggtctggcctgagccatgggtactgggccctgcagagcctggatggtcctgccctgcctcagccagagctggtgccggctgtagaaaagattgcgaagaacgcaaattcctgtgcctgtggggaggtggccacgccctacagccggggctggggagctctgaggacacattcctgcgctggtggccccgccaacccactttccagatggagagcagaggggaagggtagcctgcccaggggcacacagctcagcaatgagactcccgcccccttcccttctcagttggcactggcaccttccagcgtattgttccccatagccccgtgcccctgagatcagtaaactgtggattccttctggaatccttgcagaagtggacaccaccccccagtgagaacaggcaaggctgtttttgcagagctcgctgtagcagggagtcggccaccgccacccgcgtttagcagagactcacaggcgggcgggggagtgggaagcctcatggttttctcatatggataattcactctatacatagaaagctttttatagacacagggaaggctcggggatgccctgagagaggctgctggctggaatttgggctcctatgagatgagacaaaaatcacagaagctgtcagttattacccaggtcccagccatttggggccagtggccagattgcgggtcagagtgctgcatatatggtctggccgtggtgtgtttgcaggttcagcctcatgctgaaaagcagttggaacattctccggtgtagagcctgacggggggcctgggtgagatcgggcagccttggcagcaccacagaaggaggagagcagctccggcctcagcctccggggcctcagccggagccctgtctatgccgggccgcagcccagcgagaccctgttacactcactgcccccagacagcacccggtgggacacggccagctggggcagctcagacacagagccaggcacccaggcacgggggtataggaacctgatgggcaggagggccagtttcctcccaccgtggctccaccccactgaccaagggggatcctcttgactggggtctttcaggggcttgcacagggcaaggagcgctgggcagtgccaagaggggcagtactcaggtcagggagcatcttctgtgtccagggacaccctggggcctggggcacggtggctctcggcggcactgcttgtctctaaaaggtcaggattttttgcatggagggacccccggggctcttggctggagaggacactctggatgccaggggccgggcctgggagagttcataactccgtccactcagcctgtgccaaggggacagggactccggccaatggaggcgggggaggaaaggagggtcagttctggggcctctttaggcagcaacagccaaggcgggtgggaatatatgcagaggcccggctgcctggctcttcatggtggtgggagcaaccctactgccaccaggaggggcgttggggacctgaggctgcctgggagggacccggctgtctctggcagctcagcggtcagcagcgatgagaagccaggggagcgtgaggagcagcccaggacagggcccagagtgggtgggcagaggtggccggaaggtcttgcgcatctgggtgagtggacggccactgggtgaccaagagggccgggcctgggagggtggcttaaaaccacagtgcaccgggggctccgggctctccgttctacagtgcccagaccaggaccccctgcagggaggaggggcatcccaaggacagcctctcaggatgctcctggcagcctggtgctggaggtgcagaagaagaaactgaggcccaggcaggatgagtgactgggccaaggtctgctggtgagggcccgggctggggacatgcagatcagaaccctggcttacacctgtcaggctgcctcctggaaggagcccactggccccctggggcagttggacaggtggagggctgaggggcggtgcggggagtaggggctggactgccggaaacaccaggcttggtcgtggaccaggctggggagtgggcctgagacctcaagggcaggtgctccaggacactctcccaaggcaggaggggaggaatagagcctcctggggaggcaggcgcttgggtgctcgaccccgctcagctcccgtgacctcaaatgcccttcagcctggggtcccctgacttaccgggttgggcagcacttgaagcaaagccatgtgggacctccagtcacagcccagccgtgcccaggtgtgggactgtgggcacagacccagcttctctaggacccagccgcctccagttccccacctgttgtgggaggtataaagtgcctgccttggaggtggtgggaagccgagggccagggtggagagtgctgggccggggtggaggctcagagcgtgtccctgccaggcccggccccctagctccctccccgaggctccacgctgctgttctcagacgctaaatataagatctaagccatacatggttgcaggagggcctgggatgcccctgaccttcgaggccagttcccagggtctgtggttggggacagcggctggggggatgtggtggcgtggagctgatgtcagaggtgcaacccgcctgtcctgctgttctgttttggggaaaggcacgtgttggggctcttctgggctgggcctgttacctacccgggtgttcccagggctggagtcagacctgttgcgactgaatcctggtaaaaccctgagtgccaagggtttccgtcttcctgttggtgtgggccccctacccacatgcagacgggcagactgaggcccaggggagacctgggagtcgcccctcctccccagccacgctgctgacgctgtgggcaccccaggcatgcctgaggtttggaatctccctgtccatattgtccactggggcgggggaagtgccctggggtgagataaggcagcctcagatgcgccgttttgtcgcatcattaccgtgggtaatgttccagccaggggagcctcccgctcccccgagtcctccccaagctcatccggtcccgtcactctgcaggggccgtgctggcctcgtgctgcaggtttctgagccggctcctcccctcccagccctgagcctcggggtcctcatgcgcgcagtagggcccttcctgcctgccgcctcggttgctgaaattcggtcagggatgggtacagggaagcctaagatatagtgggggacacagtgctacccctaaccctcagcatggcacgtgagcaggaattgcagcagagaaactgagaccgagggaagtggccccgcctgcgctggtggccaggaggacagcccccatcccctccccgctgacggctccctgccctctgcctgcagctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccagggtgagccgcagtgtgggagggccgcccaggcggacgctggggacctggtatgaggcttcaggcccaaaaggccccgggaggcctggggaaccaccaggaggaagcgcagccaggcaggcaaggagggcttcctggaggaggactggcttcctgggctcaggaaaaacatccacattcactccgagtctgaggcttccaggtcaccccagtccccgcactgctgcaccagcggtccccctgtgcccctctctgttgtgtggctctgccccacccttcctccccgtcctgtgctggctcccaccctctgggctctctgccctcgtccacacctcggcggcaggagtcactgagtcagagatgcgaatccacccgagtggctccctacatacacctgcctagctccaagcccttcagcctcagcccagacagagcccttgaggtctggcccacacctactgatggtgtcaccctccacctcccagcgccttccctagcgcctccctccccgccctgtcccctactccagcacccaggggactcgttcccggcaggcaggcaggcccttggtctctgcctctgctcgtgttttctgcctttgcgtcctccaaggtcctgcgccgctaagcctttaagccccagctcactttcctgtcctccaggaagtctccccaggctgtgcccaaagttagtcccggtcccttgagagaaacccttgctgtgccactccatggctgctgccaggtcctaccgatgcttggggacgagctagggtgggcagtgatgggcggggctgggcccatgggggcggcagttacctgtgcaggcaagcaagccagaggcgcctcgtttctgtcggacccaggggacagaggcaggtgtaggggccagccattctcagcccgtctccccagcctgggcctggcagggcccctctatggagtcttttgtgaattgttctcagcagggtcagatgagagacacccccagaactttcacagctccagatggggtgggaggcaggggttcataggaatgaggttgtgtctgccataaacacagtaagtgctgcattgggagaaaagctgggcccagagccagtgacaggatggggcagctgcctccaagcccttccctgcagggtctggccctgtggtccaggagcagggccaggacaccgaggagtggggcacctcgttgggtcccagcccactgctgtgggccacagacaagtgcccggcaccccctggcgtctgcctgccaggcccagagccccagccctgagcccagctgcacaggcatgggaaggggtgcattggccctgctgagcctgcccactccaccctggcagccctggacacatccaacgtgatggtgaagaagcaggtgtttgagctactggctgccctgtgcatctactctcccgagggccacgtgctgaccctggacgccctggaccactacaaggtgggcggcagggcctgggcctgggcacatggggctccctgcctgggtgtgccctgaccccgccctccccacagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcggtaagcacctgccctgggccgcatgcccgctcctgcccgcctcttggccagtgcatcccatgctgcatccacctggggaggtgggagcgccacaaaagctgcccccgacccagggccccagaggaaggcgccatctcgggcctgccaccacctgccccttcaatggacacaggcctcagaacgcctgggggtcaaccctggaccgttctcatttgtgagactggccaggcagtggagccggacagggggcctgagacctcgttctagccctgccagttctggcagtgagccctgagtaagcatcactgtgtgtccagcatgatgtctcccctccagagcctcaggtctctggtgtcccatgagtgcagcagggcagggtcaggtgctctgggtggcagaagtgaaatggggaaggcggggagtggcctccgaaccctctgaccctgtccgtcccttcccagggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaactagggttgccaggtactgtatgggacatgcagttcattcaggtttcagatacacaacagacgatattttggtgtaagtatatcccagatgttgcatgggatatacttatgccaaaagttattcattgtttgtctgaaattcaaattgaacaggtactctgtagtttcatttgctaaatcttgcagccctgctgggaacccacatagctgagaagctctatccaggcctcagtcaggactgtactcaggggggtgtccttacacccagggaaatcagcttggaggagcccagggctagaatgcctggtgttgaaatggcctcaggggccaggcgcggtggctcacgcctgtaattccagcactttgggaggccaagatgggcagatcacctgaggtcaggagttcgagaccagcttggccaacatggtgaaaccccatctctactaaaagtacaaaaattagctggccgtggtggcatgtgcctgcaatcccaactactcaggaggctgaggcaggacaatcattggatcccaggaggtagaagttgtagtgagctgagatcgtaccactgcactccagcatgggtgacagagcgagactccatctcaaaaaaaaaaaacagaaatggcctcagcaaagtttgcccacatgggtgcctgtgccccaccagtgtgggctgaagggggccggccctgcctgcggagggctgtgctcattgaccagactgagatgactggcaagtcctaggcccagtgaacactaagtttcctcctgctcaggccagagccccgcccctcctgtatccatgcagccctgtggacccacctcaggtgtggtcttcactgtagtcacgcagcgcccaggggagggccttccctcccccaaggtcacggcccggttccattgtgtgccacctccccaggccttggtgcacgttactcgatgggagtgggcatactcgcccttccccttccccaggggcgtgcgggtgcctggtgacccgggggcagcctggcagggcgcaaggcactgacctgggagctgccactcttaggtcgctatccctggctatgtgggtcacatgtcagccacagctggctatggcctggctcagagtcccaggtgggctgagcggggctggtacactggcgctgacccaggctgccccgcctgcgtgttggtggtggcagcagcaggcttagcccacctggcccctcctgcacagagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgggctgggggctgcagggcggagggcagccctccagggcaggctgtggccctgaggtccagaggctgggcctggaacggtcctccctgccctggtcagaccctgctgtgacctgggccatggtgccagctttggggtgagactccagggagcagcaaggacccaggggttggaaagggaggtggcgcctagagcgggcagcctgggggccgggctgggccctgggggcaaagccagggccacaggacccagaaggacggggctccaaagaccagtgcggcccacagccggccttactgtcctgggccccagctgcccagtccccatcaggtgggcttcagaggcctcagggcttggtgaggggctaagaggctgaattctcgtcaagctcaggccttcccctcattccctgaaccttgcagctctcatctgggggcagttgtgtccccaggtggcatctggcaacatctgaagacatttttggctgccacggctgggcagggggtgctgttggcattgagtaggtagagaccagtggttctgtttaacatcccataatgcacaggacagtcccacatgtcaccagtaccacagtcgctgaaactctcatctctagggatccgtgggaatagagggggtgatggggctggacaccctggcagacaggccacagtccttagtccaccagggaggggccggctgctgacctgcaccccacactcgcccgtccaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatggtgagggggcggggcaggggcgtaggcacagcctggtgggcagacactgaggtcttagaccatgggggggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtggtgagggtccccagacccccaagggaagcttcccctaggacgggggctggtctctgctggggagaggggcaggtggcacatggaacttgtgtgcgcgtcctgcccgtgcgtggccagggcagcctggcccttgctctgggctcggcgcctgtggttgaggtggggacgggggaggagcagggcaggggctacctctgaggacccccctccacatgctcccgtgagccagtgcatctggggtgccatggtgccctggggccctgctacaggtgctcaggtagggaggtagggtgcctgctgtacgctggacctggacctactgggccccaggcaggacatcctttagaccctctgggaggctccagcccctgcctgctggatcgccaggccccggggctgcgagagcctcactggccgtgtccccacccgacagagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggaggtggggacggggaggggactcagaccggggccgcctgcctggccaccctccggtaccagcctgttgggtggggggttttctagatcactttcctcgatgccaagaagagcctgaacctcaacatcttcctgaagcaatttaagtggtgagtgagggaggtagcccccatcccaggccacggagcctcgcctccacctgagccttctgacttgggcccagcagtgccctctgcaggccgccatgggaagtgcacactgcatcccctaggcaggattgtaggcgggtaatagccccatgctgccccagctaggggctgtccaggctcccagggacagagcgctgggacctccccccacaaggccacagacaagtagtggctaaaccagtgggccctgactctcagcccccgagtcctttcctgctgcgggtgtccagcactggcccgagggagctggctggacccgacccatcctgcatctcctgagcagggcccatggagggtagcgagggtgggagtcagcctgggtccccttcaccgcgtgaccgtgggcaacaactcgactgttctgtgtcccccctgccctggccaccccatgactacgtggggaaaccctgccaggtggggtcccaaagaggctgggtgggggtgactcatgattcactcacccctgcccggtcctctccctgctccagctccaacgaggaggtcgctgctatgatccgggctggagataccaccaagtttgatgtggaggttctcaaacaactccttaagctccttcccgagaagcacgaggtaagaggaccacccccacaccccacccccagttagtgccaccaaccaagggagaggctgtcccgggggctcccagcagggagacagagaagggaggcatcccagccctacctctgccctgaaccgtgagccacagggagccatgatgggcactggaggggctgagcccggcgggcagtccgggagggcgggaagctggcatggggggatcccacatgccgttctcctcctggcagattgaaaacctgcgggcattcacagaggagcgagccaagctggccagcgccgaccacttctacctcctcctgctggccattccctggtgagcatggccgccctcagaccccagggcctgggccccaggtgggaggagagcaggaatagggagcagggcccagccagggaggagaagaggctgtgccaatggctgccccgggctccaggagcagcattgcagcggttgggcttctaaacatcactcgagccccacccccagtccttcccctcaaagtgtggggctggaggcctctggaggaattggatcctgctctgcgcaggcccgggagggtgcctgttggatggggcaggcggtggaaaccccctccctttgcccaccacccaagccagagccctgtgctgagtgcccctctggcagggacaggtggggggtgcaggccactgatccctgtctgtgccatccccagctaccagctgcgaatcgagtgcatgctgctgtgtgagggcgcggccgccgtgctggacatggtgcggcccaaggcccagctggtgctggctgcctgcgaaagtgagtggggccaagcggggcacgtgtgcaggagggacaggcctccgaaccggggcgggagggctgctcggggcccctgctactgccagtatcataatggctgctaagagcacctaagggtgccagccttcaccaccactccggaaaccaccctgctgccaccacctcggtgcacacacctactggacgcacagacacacgcatgcccaccgccactcgggcacgtgcacacacacaagcacactgccactctccggcacgcgcacacacaagcacaccgccactcaggcacgtgcacacacgcatgcacaccgccactcgggcacgtgcacacacacaagcccacaagcacagtcacacacatgcacacaggacacacagacacacgtacacacccccccaacacacacaccctcacatacatgtacagacataagtgcacacacacgggcaccatctctgaaaggggaatccatggggacctgccacagccactgggcagggagagggacaggtacggaccagtgaggcacagctcacgtctgtcaggcacactgtaggtgtccactcccgtcggtggagggtttgcagcccccaggccctgtcctgtgatccttccggtgctgggctgagcctggggaggagccagggagtgcaggggcactggcaagcaggaccacaccccaccgccagggcatctgggggctccgaaccaagagcccctctccagccctggctgcccctgcaggcctgctcaccagccgccagctgcccatcttctgccagctgatcctgagaattgggaacttcctcaactacgtaagtcaggggcagctccccatcccacctggtgccaggggctggtgagactcactccctgcccctcccagggcagccacaccggtgacgccgacggcttcaagatcagcacattgctgaagctcacggagaccaagtcccagcagaaccgcgtgacgctgctgcaccacgtgctggaggtgggccgtggtggcgggggcataatgggagggcttcaagtccccccggacctggggtgtagaggcgtagaggccatacccccatgcccaccactcaggccgccggtctccctgtctcagggctccgtctagagccagcagcctcagtcagagccacgcccccacccctcccagcaccccttccttcctgcagcactggctcccctgcacgagccttgtccctccccaggatacctgtccctgatctgggggacagtccctaggaaaagcagaaacatcacaaagtcatagccaggcccaagggaaagatttgagggtctggagtactgggggttttctggaccttaattgctaagggttagagctgggggagtgggaacagggtcatccccaggtggagagtatgaccacagtggatctcactggacgtgtcccattgcaggaagcggaaaagagccaccccgacctcctgcagctgccccgggacctggaacagccctcgcaagcagcagggtaggtagctcctgccagcccgcccacctcagccaggtgggggcctgacttctgtccccaggcagtgaggtggctgcccgccagggctgggtctcacagctgcagcgcagccccggcgccacggagccctgcccaatagaacacttcccttttgggacaggaccgggtctgccgtggcctatccccttctgacttaagcgaggaaacaggcctagagtgggcaagggctggccaggtcagggtcacaccacgggcaggtctaatacagccccttcacaaggtggaccttcacgacagccgtgagcaggctcgggcctccctcattgtatagatgaggaaacggaggcccaggaaagcagtgtcacctcctgggtcacacaacccaggcaggagggcagcctgggccaccccactacacagtccgggcccctagcacggagttcttcccgggctccacctgccctggaaggttctctggctcaggagctgctcagccttggggagaactaggcaagcaggacaggctgaccgttagggtccccgcccagatgctcacagggggctgagggtcagctggaacaggcactcaaccccaacactgcacgtgcagcctcagagtacagcctgcagggtgcacagtggggtgccggggggtgcaggggaggggctcccctgtcccagcgaggctgacgtcagccgttgctgtctctgcccggccctcctcacctttcaggatcaacctggagatcatccgctcagaggccagctccaacctgaagaagcttctggagaccgagcggaaggtgtctgcctccgtggccgaggtccaggagcagtacaccgagcgcctccaggcaagtgggcacctgggcctggggctggcgggagaggctgccctgatagagtgagctgggcgagtggctgtgctgtctcctggctccagggtggatcctggggcccgagtttccccaggtgtgcatggtcagggcacaggcccctgctccttgtcagagaccaccgtcctcagggcctgtccctgtggccgtcaccctcccgcaactcagggcctcaccccgggtggtgcccgcgcggggctctcacgggactgtcacgtgcccttgcccccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggtggggcagcccggcgggacacagcctgtctggctagagtggggtcccgaggcccctggccttcctccggcaggatgggcagaggcacctttcgtcgggccgacacagccatgtgggccctgcgctgctgcggctcagggagggggacgcccaggcccatggagcccctgagggatgccacgctggggtgacggggccacatctgccagtgcaggagaacaaggaccggaaggagcaggcggcgaaggcagagaggaggaagcagcagctggcggaggaggaggcgcggcggcctcggggagaggacgggaagcctggtgaggctgggccggctgggcggggagggggtgactctgggatccttgtctgtgctccagcctccccaccacccccagccctctaggtgggctccagggtcccatgccgctctctgagtgccccacgctcctcagtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctggtaagaccctctcccactgcctcctcatggtccccttgccactgtccctaccctgtgcctccaggaagtcctcctgacttcactggaaagccctctcctctccctgggccaccctggaggcccctaagactggggacagccgaggggacaggtggtggccgctcagccctcatccctccctccactcactccagctcctccactgtaaccgcaggccctgccctcagtgctgaagcagcagtccagcccgctgggctccagagagatgaggccaggcccactgaccgatgcccttgggctcagagggtgctagaggtggcaggaaaggcaggcggcaaggccctggtgggaggaccccattcctggggtggctgcctcagggtgctgggaatggcatggcccagtgtcccccaccctgccacagtgtagacagaccaaggacgctgaggccgggtcctgctctgagacatcagaggaggctttctggggaggaggttttgcagggcgttcaggtagacagcggaatggaggaggctgcacctgggctggctcgggggcagggtgcctgcccttcactggtgtgtccctccatccagtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcacgccacctccgttagggagtagggggcggacaccgggcaccaggtcccaggcaagtggctgccatgtggcttagtggccagagaaccgggcagccctcagagggtgttggcatggctgtcccgggccccccagccccacccactccgagtcagggttgcttctgtgtgataagccgttgagtgcgtttcttttatttggaagcagaggttccccctgattctgatgataataaaacaaagaaactgtgtgtgatccagtaaggtatgtacgcagccggcgctccgtgggggctaacagcagctgcagggcagtggggctggagcttgctgcccacacccctccgggacactaacctggcttctctccagcccgcgtggtgcgtcagtgtggccttgccgctcccgcagccctggtggtgggcttcccgccccatcccctccctctccgcaggttacctgctcaactggtgcctcctgcaggcaggacgcaacctcagtgctggccccgggcatgcgggcctcgagagggcaggtggcagggccagccggactcccttagcaagcaggatccgggccctggggcgtgggcgggacctcctggctggcaggacaggctgaggttgctcctgtctggtgtcctggcgctaactgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggtccgtccacagggctggagaggccaatgcatccagctagacaggaccagcctgcactgggtggaggaggggctagagcagagaaccagaaggtccagcccggccgatcatgagctctgtgagcccaggtcgtggcgtcttccagcacctccagccttgctcagagccagcccggtgtcggtgcatcacaaatatgctgaccgctgggcctggggcttaggctcaaggtgcacacctgaggtctgctggtgcccatcagaggcaagagcagtcgtgaccccggagaagcttctccggacagcttgtcctcgctgttggggcacggccttcaccctgggttccagcttttgcttccagggtcatcttccgagtgtggctctctggtgtgaagcacccacgtgtactttttagaaaggtgctggcatctcccttagaggctggaacttggacttgctggccctgagtgtgaggaacagtggagcatgcaggtctggggcgggcggccacatctgacaatggtccagtgaaagatggacgtgtccagtgccagctccacgctccacctggttccctcctgaacctgctacacgtgcttagcctccacccgccccagctcctgccacgcacgtggctgagggcaagaggaagaagtcctcttctctccccaactttttattttttattttttttcaagacggagtctcactctgttgcccaggctggagtgcagtggtgcgatctgagctcacagcaacctccaccttccaggttcaagtgattctcctgcctcagcctcccgagtagctgggaccacaggcacacgccaccacgcgcggctaattttttgtatttttagcagagacagggtttcaccatgttggtcaggctggtctcgaactcctgacctcaggtgatccacccgcctcggcctcccaaagtgctgggattacaggcgtgagccaccgtgcccagcccccacctttttatttagaaaatcttcaacaccacaggaaactgcatagatcagaatgaacaacaccttctccccgaaattacaaccatttgccaaaaataccaaaattgtgaccattttgctacattgcccccctccaactgaggcatctgagagtttcttataaacatcatggcactggagccctaaactcgcccacagacacctgagagcacagccgtcttcctcagtcccccccgggcagggtgcgctgccgtcctcccagtccgcccccaccgggcagggtgcgctgccgtcctcccagtcccccccccgggcagggcgcgctgccgtcctcctagtccgcccccccgggcagggtgcgctgccgtcctcccagtcccccccgggcagggtccgctgtggggcgcttcacgtccacatgcttctaatactcggtcccagtgcagatgtgccacttgccccaataattccttctctagttgttgctttgttgtttttgcaaacaagattgtatccagagtcacatgctgtgtttggttatcatatcacttcagtctcttttgttctagaacattcctgcccctttttgtcttgtatgacattgacgttctggaagataacttcactttgggtttgcctgattgcgcccccaagtaggtccaggttgagttttggggcaggagttctaccccaagggatgccatgtcctccccagctgggtggggacgtttgtggcagcagcgctgaccacggctgcgggggtggtttctgaacctccactgcacgaacaccacgctgtctggttaataagcaccggtggtgacctgtggaaccaaccgctgcagcgcggttctgtgttcgccgcccctcgtccgagcgttcccccctcccctccctttttccatcacgtgagttttgaacgtgcagtaatccttcactgccactgccgtgcatttgatggggaccagcgggggccctgagcgcttcccatctttggcacaagcccctgttcctagctcaccccagacttgctgatccccccatccctgcacgggccttggtcttggccatttctccaggttccctgagtggggaatggtgctgagaccctcctttgagtgattgttttggatagtttttgttttcttgctgtctgtttagagtagtggttctcaaaccctgcttgggccatcccactggggagctgggacaccacctggcactgtggtggcagtgggggtgacactcagacaagggccatcgagggcccctggaccagaaagcgaagagggcgttgggggcaggaggcctgtggggccatgtgtgggggccgtctgggtggcgggagctgttggggcagggctgagcgccctcagcagcccactggagaaagcgctgctggggtcctcgtgtggggcccagggcccgacgtggaagcaatggagggctgcagggggtggcagtggggatgaatgagtaaggacagagtgcagcctgggtctcagacagggggtgggggacaggccacagagattccctatctcagcagagaggagacaggctcaggctgccacgccttgccaaaacccagcctggccaggccagcccggcaccttccacctagataagttgtgctgctccagagaaagagcctggggtcagagtggacctgcgatgcatggcacaacctgctggacagtggcgatgaggggttcagggacctgggcacccagaagcgggcacctgatattgtacccagcaaaactgctcctaataatgtcattttttctctctcttacaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccgg

SEQ ID NO: 1311 - DNA, 6528 bp, Homo sapiens
ctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcggtgagtgtcgggcgggctgccgagggtccgctgcgtcggggcctggaacgggccgggcctcagcgtcccctctgaggcctgagcggggggctggagggccctgctttctggccccgcgttcccggaagctgggaggccgcggggacacaagctggccacgcccagggctggggtcagtgagggggatgtgaggaccccagcgttcgcccaccctgtccaacagcctgaaagaaaagggtccctgcccctagcccccgcgccctcttccacgatcccggttagtcgccgccctgcagtgagcggcacccgcctggtgctttctcaggactgtcccgtgcaggatgtcctgggagaggttggggagcggggcgtcctgcatggagtcaacccgaagagtgcccctcctgtcccaagaggtattcatggagcgcgcggccctgccaggcacggcggctttctcgggagaccaaaggcaggcaagacagatgtgccccgtctcccgggagctccccagcctagttggggagaccagcaggaggagtcgccacaggtggtcggggcaggcacaggtttgtgcaggcgcacctgcagggatggcacggaaggcttcttggaagaacagtctgagcggaatcctgtgggggcgagtaggagttagccaggcagaggaagggaaggaagagggcgaggcagaagccaggcagcaggagagcgaaataggactccgtgtggctgcagtgtccagttctgggtgggatgtgagggcagtgagctcccaggccttctctggctttctcctgtggatttcaggcgtgttgatcttattgatcatcactctgactggggtgattaataccctggggcaggtaaaaagtggagcttaccttgcctagtgattgggacacaaagtctgcacctgtagagcagttagaggatgacccggggtgtgtgatttacctggtgccgcttgtgccttgggaatgagggaaagactctgcctcccgaggttcctctgtgcggtgtctccagtgtgctagggctgtgaaagcgagtgctattctgggccatggggaggtaaggggaatgatgccgtgggaactgtggcaggaccgcaatcgtgtgccctctcaggacagttgaaaaattcaaacactgtgcaggcaagaagaggaagatggaaatggggcctggctcagtatggccctttattcttcccgagtgtcctgacctgggcgttggcaggtgtgtgccactcaccgggtcaggtcagggaggtctgctgggtgcagtgggccttccatggtaaatgcaggacacctactttgaactgtgtgacagtttccaaattccaggccacagctgttaccctgatctcttaacctcgaattgtccacaaggccttgaggacaaggattagcctcaccacgtgtctgtcccattcctttccccttatagatgggggaaggtgtggggggccaggaggaaggtgcagggtgttgtgggctggcatcagctactccatgtgagttaccctgtcactattattgctgcccacttcatgtagagccacatagagtttctgggatctctgcctttactgtgttatggtgaggtgcaaaacaaaaaacaaagcatttctgggtctggccctgggcatctgatttttcaaagctccccaggtgactgaactgtggcctgatggaaaaccactgctcccagggatgggtgggtgttctagaacaagaggtctggaaggttctgggatgcttgtcttgccagcaactctgtagcaggtgaagggggtgtgctctggccagaggctgtaggcccagctccaagcctctggctgcttccttggcaggggacgagttttgtgaattagtgctccacagtgcagagctccctctgtgcattccacagagcctggtttccaggtggggagtgctggggaagcagaaaagggagaaaggggacaagcttagtgaggcgaggccagccgtgaattgcagaaaatgagccgagtgataggagagggaacccttgcatcagacacaggtggggctgcagggccagagccttcctggaggagatgacagctaagccaggtaaggaaaggacgcacaagcattctcagcatagaggcagagcaggacccagctcgccagggcacaacacaggctggggttactgggagacagagggcacacaggaggacgatggggttcatgtgaggctagaaagactcaatggccatgcaggggcttcgttggtacacagtgaaggacgtgagaatgatttatcttcccccagagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctggtgagtggcaccagcagccctttgtggctgtggcactgagggcaggtggtggcacgagcatttttcttgatttgcaaggtcaggcttttcctccctgggtaagcaggactctgacccagagcttggccttctggctcagaaggctcctgttatcaggaggtctcacattcaagactggaagttgttaaacagcttctaagtactgggccaaaaaagcagcagagactccccgggtatcccgtctgctttccgcctgcagccccctcagatagtcccacaaggctggaaacatgccagtcccatccctatgcagtgtggggtctcagagcatcacctgtgttgctggttagaaatgcaatccccgactctacctcaagtctggttggtgtgtctaggaggagcccaggcacctctttgttaaccagtaaggcagtgggccacactgagacccagatgggacacatggagttctgacaagcaacaggggaagaatggtccttccagcactagcctccaggtagcagagggacctggtaagggaaagagcactgaacttggagtcaactacaggcatatctcaccttggatctctgtagtaaaacgggggtcctgtgcactgtaccaggctcacgggttgtcagaaggatccagtgtaggtggggatggggtaggcaggtcagagccctctgccctcaggtatgcatggaggcaggtagcccggcagtcccggaaactccagtctccttgcagcctgacggcttggcgtttcttcctcacagacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttgagcacccccacctcctcctcctctggtctttgagccccccctccccccgtccgaggagcccctggttggtgacacaggtgcacaccgcagcttcaccacagtcatgcgtgccgtttggttgtagaccctctcaggcaggaagtggagtgtttgtgtagtctcccatttgtgggtgggtttgctgcagctggctggatcccgtccttactcctaaggtggggaggggcgttctcaccctaggggctactcacctggtggatgggagtggacagtgtggagcctgtttgccctgccccgtgagaaagatgacttcatccagacacatgtggaactggctccatagacccaaagcaagcttagtccaaacaatgtctgaaattgtccatctaaaatagaaaccacatgttacatctcgagtcctttctctcgagcctttcttcagtcggggcagaggcccagactcattggagacggagagccctgggcagggggggcagcaccagggagaagcgccgcgtgccagtgatcggctcccatggcttcagcatgggcaggagtggggtaacgcaccccatccaggttgggaatcatctgcagggctagctatgaatgtgggatactctgtctttgcttttcacccgctgagttcatcttctttcctagaagtaaactgaaaagggcagggttttctcattgtctggtggccctctcaccaaagcagaagtgaacatagccatgggcaggttcagcggagaggtgggtcccagagcgctgcgtggctggcctcccactcctgccctgcacaccatccttgagggactcccttgcgcccatttcctcctggcctctacctactttctgctgctgcttcctcccatacccacagagttcacgttgagctgagtgggccactgtccccactgtggacacactcttttatcgcagctacagcacaggaggtgggctctgccctctttcacaaataaatgacttgttccaggtcacaagccagaagtggcattcccaggccaggcagcccagctggtggcacccgcagtctcctaccccctcccctgccatttcctacttcaggaccaggcgtcgcaggagtgggggaaaacagggatctgtccacacggctctggtttaacacagatgcagcccagcagcctttggcgtcctgctgatggcctgcactggcccacgcctggcccgtcctctgcagggctctccagctggctgccggtggcggtgaggggctgtcttcgcggctcacccacaatactactggcaaactctgcaaaccaagtggcaagcagttctggctgccttgttgactccacggccctgtcgtgtttggggtagccattgccagtcccgtttcctcgcaacatctctcttaatcactttctccctgtgttttgccgggttccctagcctttacctttagagctttcttttttttttttttttgagacggagtctcgctctgtcacccaggctggagtgcagtggtgcgatcttggctcactgcaacttccacctcctgtgttcaagcaattttcctgtctcagcctcccaagtagctggagttacaggcgtgcgctagcacgcccagctaatttttgtattcttagtagagacagagtttcaccatgttggccaggctggtctcgaactcctgacctcaggtgatcctccggcctcagcctcccaaagtgctgaggtaagccacaccatacgcgtgagccaccatgcccggccctacccttagtcttgatatatcagaaaagcactgtttgatgtgcttcagtgtaaaccattgtggttcggtgaattctggcaggtcatctggaggtttctttggagagcttctatcctactggaaacccaggttgggccccatgtggattgatcggcagtgggaatcagctagggctgctgtaactgagttcgcagacccagtggcatagacagcaaagaggtactgccacgtggctttggagaccagaagtctgagaggaaggtgctggcagggctggttccttctgaggctgcaatggaaaacctgtcctggcctctctcctggcatctgctggttatctttggtgttccctgtagacagctgccccctccctgtatcttcatgtcgtcttccttctctgtgtccttctcttcacgtagtctttttaggacgctggtcgtgttgccttagggcccccatgtcagtgccgtcatctagactgatgatgcccgcagtgatcctgtctccagataaggtcatgtcctgaggtgttctgggttaggactttgacgtttgaatggtggggggtggtggacacaattcagcccctgacagcagcttttctctcccctccctgacgctgtcgcagctgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaaga

SEQ ID NO: 1312 - DNA, 17421 bp, Homo sapiens
ggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtggcgtacatctgtaactccagcactttgggaggccgaggcgagcggatcacttagggtcaggagttcaagaccagcctggccaagtgaaacccggtttctactaaaaatacaaaaattatctgggcatgctggtgggcgcctgtagtcccagctactggggagggtgaggtggtagaatagcttgaactcaggaggcagaggttgcagtgagccaggatcacaccattgcactccaacctgggcgacagagtgagaccctgtctcaaaaaaaaattccattgtttaaagctgtccaggctgtgtattttgttttggcagccctggagactatagatagatagatgatatggagagaggtgtagagagatatttacttataaatatatgtacatatataaaatgcctggagggaccagcaatggtgggaggactggggagtggccccgagaggtgctgcgggtgtgagggtgcgcacagcctcctggaggggaggggcctgagtggggcagtggagatagggctggccacagggccgtgccttccctggcccccagaggggtgagttgggtggacccgcagggacaaagcaggggtcagagctgtgtttggttcctgagtgggccttgtccaggatggagagagcctcttttcctaaactccctgccaccagggaggcagctggcacggatgtcccctagggactgtgagtgacaagccagactaggcagagagtggggggggggggggggctcagtgtccgtgggggctcagagctgtgtcctgacccaagcctgcaccacagaggggaagaccccaagagaaacctggaggcaggtagagagcgccagggggccaccaggctcccttggtgcccctaactctgggcccccagcctggtctgagcctttgggtacaggtcactcaaggcaggtgttctgcaccatccatcttcatatcgtctctctcactcgcacccttgcatcactgtgcttctgagagttgggcgcttaccttaatctactgtccctgacctggcaaacagtggaaaggtggcatgatgtggccctgcagctgctacacctctaggcgccatcattcatgccatggctctgtgacagcaccccctagagttgtgcagtgtgcaacatgggtgactgtccatggcagctcacagcatgtggctcagcccattggccatgcagggggctcctttcctaggagcagcagggctgggcttcctctccacctgtaggggcagcagtgggcatcttaggtaaatgcaggactctgcagcccctagaggaccctgagtggtggctgaaggatggatgtgcccatggccttcccagagctcaggtgcctcagctctgctttcagaggagcagggcagccgaggggtgcctggcagagaggcctgccggctggacgtggggaccctggagcttggcctgaggggctgtggtgggagccgtgcctgagcagggctgtcccgtggcacacactcgccctggctcttctgcccatcacttatccccatgaggcaggaaagacagagtgagtgcggctgccctgggggctcggcactggggggatggtgacaggactcggggctcagggccgggctgcctggaacaagcagaccctgaggggccccctgcagcaggatccatggacccatctactgggccagcaggggccaggaaaggagaagagggagaccggtggggctggaggcaccagtgcgtctgtgcaagaggaggaagccctgtgagagggcagcagcctccggactgccctgcacaccgtgctgagaggcctggcgtccacctgcagcccaaggcagctccaaaagaaggtcctggtgcttctccaggaggcgaggctggccctgatgtttggtccctcctcatcggccagcctcatggtcagccttggctggtggctcccatggcaaggcagaccctggcctggacctgaaggctctgcctttgtgcagagccccagcctgacggtaccagttttcctttgttcccctttgtccagccctccttggatgcctttgctgtgggaatcccaggctgaagctggaggaaaggcaggaggacttcttgtccccagcctctcaccacgtgcctgtgcagcctgacgtcctgagacctcaactggtgatggggaggacagactggtgtctctctggggccatcgtcctgggctccccagaactgggagcccctgcggatcagcaggccccaggctcagcgtcctgagctggctcctgctcccaggggtggcctggcactggccctgcggtcattggacacccactggcctacgacaagccgcgcctgttcctaggagcctgtgtttgcccccaacagagccagggtgtgcctagcagggcgttcctgggcctgttgacgtgggcactgggcactctgccatggtaggcagcacttggcctgactgccaggtcatccctcgacgcctgcccccccgcccaggcggggctgtgtacaagggataggcttcccttctctcagtttccctacctgtcctcagagacctcacccctgactgcccccaaaaggcagcagatgcagtcgtgggcatgaaggtactccatgaccccagcggagaggaattaccacatatgtgccgaggcaaggacagagtaagagtgggggtctccaggagggtgctgtgacccccaaacccagaatctgttcgagtcacgccagggcctgccccgtcccgatggactgaacctgtgcgcccagggctgactcagcgtctgctgagcagcacaggctgagagccctgcccatccgcccaggctgcagaagtaccctgaccctccacccccaccctgccttggcgcctggcagcattagctcccacaaggcctccaggtgccctcagaccaccctccctcctgccaccaggcttcctgcatctctccacctcccaggatccccacccagttcacccagcaccgccccgcccagagccactgtcctgaactggtttcctataaggactgggcccagccaggcagggccaggcagaagtcagggcgtggaggtggggactcctgccctgcgaaggggcttcagggctctgagtgctgcctaatctgccagtgtgtgaagttacgtcccaggagggtgagccccctgcctggcatctctggatctgccccccctctgtccccagggttgccctgccacgaggcgccggggctgtttccgtgtaactcttgtccagatgcatcgtgaggagctagtgcagagggagggggccgccatcacggagggtcctgcttgggcaggcggggaaaggctatgtgagacaccccactgccaggcttgtgagggtgggaggggagctgagacccctctgccgggcagagagcagtggggtgtggctgggagaatcccccatgcgtagacaagttgagggcttttctgccgggaggtgaggcaggaaggtggggctggatctgggctctggggtcctggggacagagtgggccccaaaagggaagtagtgaaggagagaccagaccagtctgtggggcagggtatccgtgtgtggccccccgcaaccccaccgggaccctgcttaccctccaggtggagctcaaggagagagggcaacaggaagggtcccccatgccatccagtggctggccagaagtggggctggagacctggccttctctcctggggcagagaccttctggggctccctccaggctctgtcacactgggcctacaggggtctcttatggtggcataaagaccaaaaggtgctgtagggatatcccttgccgttggtgggggcctggcttcaggggcaatgagccatcatgggccatcagagatgctgcctcttcctcagctgtgaagcggggcctcctgcctgcacgtaggggagccctatcagccgtgccttgggactggagtgtccctgtatccatcatgccaccagcccacctgccctgcaggagcagagggtgggggcagcaggggacacccactggacctgtgccctgctgagcagagccaagcaaaaggcaggagggctttggttcttgccccacctggagagggtccctagcttatcctctagcttccactggcacaagaggcccttggggaagcgaaggcagtggcatccagggcgtggcacagtttgcttgtatcatgtggctgtctcatggcaggagggggattggagcctgcacatgctagtcccaggccctctccccaccatcagcaggaatccccccagagaggggagcctgtggctgggtgtttcccagaacagggctggctcagaatggctttttctttttcattcttagacgggaggtgcctgcccaaagggaagggtttctgctaaagtgggtgagggcaggtttggccgtgggggtgctgaattcatgttctgtgggagggttaggcctcctcattcctgcatgagaggagcgagctccagagcggggcccgcagctgcagagacctgcaccaagccacctggaggtgttggcaccagcctgggccagaccctccccgacccaggcccctgaccaaactgctgccctccttccaaggtgcaggatgcccacatcccagtcccgcacagacgcatcagagctggccaccaaaccagacaccccaaaatccaacagcagtgccctgcagggacagacgaagccccatgtgggtcagtccatgtccggggggtcctcagtacccaagtgccttcagctcagccgggtttctgttccaggggggcaacaacgccggccacacggtggtggtggatgggaaagagtacgacttccacctgctgcccagcggcatcatcaacaccaaggccgtgtccttcattggtgagtgccctgccccgacctgtgtgtgagcaggaaagggggtgtcagccagcccaggagccccacgcatgggggcacggggcaccagagcctggtgatgactgctctagcagtaggctggaccccagcctccacctgccccaccaggcactggtgcacagaaacctgcatagcccgggcctgggctgggaacgcagctgagaggacacagggctgatgggaggaggggcagagtcacatccaccgcgcaggagcgggagtgcctgatccctgatccctgatccctgatccctcacatgcacatacttcctgtgtgggcatggagaccacacgcccatgtgcccgtgactccatgtgcatacctgtgagtgagtatgtgcttgcgacaggcctggcttctcgctgcgtggcgaccaggctgtgtggacaaggccgtgccctccccggccctgccgagccatgtggccgtcctcttgcctgggctgctgtggccacgtggcaggcctggttccagccccttcccagtccgtgctgcagagggacctccttccacatcgcctgccccctcctgggtccggacacagctcctcccctgcagccacctgtgaccactcagtgctccaagaggcgagccacctctgtccccagggttccgtggctctttccctccttctctcggtcagaagcctgctctgtgcaccctggcctcagctcttagcccaaaacccccttgctcagagaagcttttcctgatcccagtggccaagccagccaggccccttcttgtactttcccttccagctgtttccagacttcagcaaggccatccttgtgatgtatctgaccccttcccagcccgtcaggaagtgggggtcaggcgcctcaggtgtgtgcccagcagatgcatgggcctggacccattcaatgtgagcagagggaggaagatagcgcggaggtggctgccgcaggggccatgtgtggtcaggggctgagctggagtgactcacccaagaccatcccctggggtgcagacccagtccctggccctcccagcagtggggccaggacagtgtgggggcggtccctagttcacagcagggaggccctaagcagtgaggtggcctgcccgccatgtcgcaggagcccctagccctggcagactgggcagtagcgctggctggccgctccgggttgtgctgcaggaagcccttctccagccgccagcctcgtcctgcccagccctgggccccacatggcaggaaacaaggccaaagaggcaccgcttagcaagcggcaggacgtgccagggctcacacagacaccctgagcttgcaacactccgggcctctgccgcgtgtttatttcaggatgccgtggcatttgggtgaccttttgtgctcaccatggcttgcgtcgtctccgggtcactctcgtctggactgaagtcccgtctccctcagctgagcctgtgccatggccagcctcagcgggaactggcaaagggaaaggggttccttggggaggcagcaggggtttctgaaggcttcatcttcaagcaaggggtttagagctcaggagtgtatttgtgtttttttgttttttgtttattttgagacagggtctggctgtgtcactcaggctggaatgcaatggcacagtcctggctcactgcagcctcaacctactgggcccaggggatccccctgcctctgtctcccaagtagccaggactacaggcttatgccaccgcacctagctgatatatatatatatatatatatatatatatatgcatttttttttttttagaaatggagtcttgctgtgttacccaggctggcctccaactcctggcctcaggcaatcctcctgcctcagcatcacaaaatgttgggattataggcatgagccaccatgccccaccagagcggtgcatttgtgacaatcgatgaacctacactgacaggtcatgatcacccagagtacatagtcacctctgggttcacacttggtgctgtacattctaccagtctggacaaacgtatgctgtgtatctgccactatagtatcgtacagaattttttactgtcctaaaacccccgagctccacccatttcattcatctctcccccctcaaccctcggcagccactcaccttatgctgtctcctcagttttgccttttccagaatctcagagttggaattgtacagtatgtcgccttttcggattggcttctttcactcagtaacatgcatttaactttcctctatgtcttttcatggcttgaaagctcatttcttttcagtgttgaataatactccactgtctggatggaccacagttgatttctccttttgtttactgatgggcctcttgactgctgccgagtttcggcgattatgaatagagctgcacatctacgcgcaggtttctgcagggacatcaatttccagctccttaaataccgaggaatgtgttttgcatccatcaccaccatccacctccagaactttcttatcttcacacactgaaatgctgaaatatcaaataactccccagtctccctctcccagcccctggcgcctcccattctactttctatctctatgaatttcacttttccagggacttcatataagcggaatcatcctgtttgtgtccgtttgtaactgccttatttcactcagcataatgtcttcgaggcctgtgtcagaatttccttccttttttaaggctgaatactcttccatcgtatgggtagaccgtgttctgcttacccattcatctgtcaatggacagctcttggctactctgaataatgctgctatgaacataggtgtgcccatttcatgctgggttgttttttgttgttgtttgtttgcttgtttgttttttgagacggagtctcgctctgtcacccagagtgcagtggcaggatctcagctcactgcaacctccgcctcccaggttcaagcgattctcctgcctcagcctcccgagtagctgagattacaggcatgcgccaccatgccaagataattttttgtatttttactagagatggggtttcaccatgtgggccaggctggtttcgaactcctgacctcaagtgatcctcctgcctcagcctcccaaagtgctaggattacaggcatgagccaccgcacccacccatttcatgctgttcttaatgtatgttttccagtgtctgggacacaactctgtctctcatgcctctgtctctcatgcaggcaacggggtggtcatccacttgccaggcttgtttgaggaagcagagaagaatgaaaagaaaggtaggtccaagctcctgcagacttgccctgtcccagacgcggtgccctgagcggttgttggctggagccttcctgagggtttctcccacggaggggactggcaggggtgggttcccaacatagctggcccagctcatcacccgccggctctacccgcgcagaaagcgagtgagctgggcaacccagaggcctcagatgctggtggcctcagcatcacggggccaggtagcacctgggaagtccaggaaggagccagggacctggaccagacacccagtgggaagtggggactgctggcctaactatgcctgcagggaaggatgtggctcctgggggctctgcggagcatctggccaggcacgcagaggccagacccaccagctgggggtgtgggcaagtcagacctagtgtgggcagggacggacggcagcctgagtgggtctgggaggacgctgagctgcagcctcaggctcaagggcgggacgggtgtgaaaagagcaagaatgtgattctggggacatgggcaccagggggtacccagactgaggccctgagggggcaggtcaccttcagagtggcagcagctagggaggaaagccgggcactcacaccagctctggcttcccagcctggagtgggcgaagcctgcaggcacgagagtgggcatcctggcggcggggtggagtgagggtccgggagtctcagctggggaggagacaacgaggggcgggtctgccgcttgctgcgcaacagaggtggccctgtcagcctcctccctgcatgccttacctggatgggagccgggcgagctagcccagctctggcccctcacgtgtgagctgcagcgcacctgtgaacactgacccacctgtgtgccgtgtccccgcaggcctgaaggactgggagaagaggctcatcatctctgacagagcccaccttggtacgtttcccactggagtacagggaacagcccctcctgcccccaccattgccagccggccctgctcctacatggccaccgagatcagggaagtccccaaggccttcttgctccacatggctccattagcttgtacattacccttttcaaagagcttcaagttgggagctgggtcaggggtcactagcccatttgcaggtggggagactgagccccagacactcatggtcacaccccagtttgtcctctttgaaatctcaaccacccccttcccaggagactcaggccagcaggaggtgaggtccatgtatacacatctgtcctctgcttctctcctgtctcctgctgccctcacctggcccgcccgacagtgtttgattttcaccaggctgtcgacggacttcaggaagtgcagcgccaggcacaagaggggaagaagtaagtctgccgggacactctcaccctcggggagtcttctgggcccgtaagccggtagactgtggggcgtgtctggtcctgggcacaacgaggagggtacctcaacccactcaaagcccctggagaatggcaccgtcaaaattccacagcgcatcacccaacccccggacgagccagcccgtctctctctggggttgcacactgtccttgccggctgccactgccacgcggctccccccaggagtgcataagccctaccgtcacctgtcacacccaccacctttcctgactccacacggccccagggaagacacgaggaacactaaagcagtttagtagaacctcagatgtgccaaggacacaggagtgaagcagatgagtgtcctgcctcagagaggtgatggtcacacacttacccactcacactctcacacaggcacacactcatgctcttacatacacaccacacgcccacgcatgctcgcacagttatgcacatgtgcacacgccacacaagcccacacacccacgcaaatgcacaaaagtacacacagccacacatgcacacactccacatgcacacatccacccacaggcacacaccataccagtacatccatgctagtgcgtacacccacacacgcacacactcacagctcagccagacacaggcagcaatggtgggcactggagtcatgagccggcgggggtcatggcctcagtgggatgcctgagctcctcagggctcctgggttctcatgggtacccactccccatctttcagtataggcaccaccaagaagggaatcggaccaacctactcttccaaagctgcccggacaggcctccgcatctgcgacctcctgtcagattttgatgagttttcctccaggtacctgagccgtctgcagtccccggggaggatggggagaagttgccggaagggactgtggctagtggggagggccctgaggaccagcatggaccatgacagggggtgatgatgactgtcccttgtgcagattcaagaacctggcccaccagcaccagtcgatgttccccaccctggaaatagacattgaaggccaactcaaaaggctcaaggtgaagtcggggccgcagtgtgggggctgcggaagtgctcctccagggaggctggatgtcctacctggtgctcgttgaacacccttggggcacacctgatactaggcattgttatgggctggccaaccttcttgggacgcaggcctcccctgccccaggccacaggctcactctgctgcttggcccttccttgcagggctttgctgagcggatcagacccatggtccgagatggtgtttactttatgtatgaggcactccacggcccccccaagaagatcctggtggagggtgccaacgccgccctcctcgacattgacttcggtatgtccgggagggtgtgcgtgccaacgacctttcgtgcctgccagggaagacccagctgcggagagccgtgggaaccgatgggggagggaggggcagacccgctttccaaggccacagtgccatccatgcccgcggaaatgatcctcgtgtccttagtgttcctattgtcagcaagggaggggagaggagaaagggctgggctagagatgaaagaacagggtgacaaggtcaggggtggggccagggagcctggcaaggtgggtcagagccagcccttccgatggtctgtacagccatatcccgtcctcacccccacgggcgcaccagcttaccctcacccccgaggcggcctggtcacctcaggccatgctgtgggcaactttctccctcctctcaccccagactcttttgtgagccacatggcccagcacacagcacccattcggccactccaccaggacaggccaggctggcgaccccacggagggggccccccacggtttgaactgcccactgccctttactgagaaggcctcttgggccgggtggaataatctacagggggtgacaggtagccccctaaacctgctctgtcttgcagggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgtgagtccccagcccctcgggaccccgtgggaggacagggaggccaggcaggggtgccgggggtggggtgagcagtgccagggtggaggctctgcggaccttgccagtgccatctccccatctcccaccagggcgcttcctgccgtgcaggccaggggagagcttagtaagaggcgctggggtgggcctgttcccacggccacagcacgtgagctcacacggggtgcgcacatgcccacacgtacacgtgacctcgttcccctcggagtgtgtgaggcccacaggcaagtgcggacgccttgcagttcctcaggacaccctcattcggggtagctggtggactcaccttggctcagagaggacactaagcatcttccctcagccttgtccccaggttggggggtcctctgtcacaaccaagctagaattggggctgaaagccaacccccacaaccctgcccagctctccagccccaggaaggtttctggaagctgctgtggccccagaatcctcaggagaccccagccttcctctttcaccctcaacctgtgacccttggtagggcaaggacatggcccttgtgcctgagcaggaggaagggcaggtgctgggaaagccaacacggggaggggcggacgccatccagagaggcttgagagggtgcagggatacatatcgggagatacacacacccctgacccccaaagccaagctgcagggccaggcccgcctcccccagctgcccatggcaggaggggaagacagcaaggctgcccgtgccttccccagctcacaaagcctagtggtctggtgtgttcaggaagagcgctcgccggctcgggtggcattgtgggccaggccttgcccattgtgagcctcagctgctggacaggcttaccaggggtgtggggatgtccgggagctggatgtaaggactgtcggtggaggcggggcaccctcagggattctgagagctgtgtgcagggaggagggggagcagcagggccaggctgcacaaggctcccacgacagctcacatgacgtcctccctgttctcatgtaggagattggaggcctgctgcagacccgcggccacgagtggggagtgaccacaggcaggaagaggcgctgcggctggctcgacctgatgattctaagatatgctcacatggtcaacggattcactgcgtaagcaacccatgctgccatccccactgggaccgtccctgactcccgacacctgcagaggcaagcagcacttgacgcaggggctgagggccaccaagtctccttggacaaggtttccactgatctcgacccttccacaaagcacggcccagaggttagcggtatggaggcctgtgcagggtgtgttggagccagccgtaggagcacaaactcccaccccagggctgatgccgtgaaggatgagggcatcccggcacttgtgagaggttaaaatgcttcatgtggagagcggaagtacccaggacgaaaggatgcactgtcatcctgctagaaggacggcagcatgggtgccggcctgttgaggcatccgctctgcaggcccctctgctttccacagactgacccaggctgcccagctgttcgggctgtctcccagggatctgaaagaggctttgtgtgaggggtgggctcacagcttcctttccagctcagtcagacaggccaaggctgtgagtcgcacatctttcaccagggttgagagcatcagccaaaattcctggagaattaaccagacccctgctaggtgggtatagagctaatccggcaacgggaagcagaggaaccgagtagctgagggtgtggcgtctgggatccgtgaccctcactttccttgtgcgcgatgcagggttcacggcgcagcctcatcacgtgctagggccagcatggaggacaggcagggtcagcagtgctcagcagacccatccatagcctgctgcatctggcgccccttcaggctttgcccacggagggaggaaaaacagagcccatggcacagggcctggtgccgaagatggaccaggaagggaggctgccatcattggcatcagtgggtgggtgggcagggaccaggaaggtgactaggacaagggtgccatgctcacgggctggacacagggcagtgctgggccctaaacacggctgtgctgtggggaaagtgcacgtgtggggacgggaggggagaagtggagcctgggggagcaggggtcccggggggcactcgaggtacaggggacttggaaaggcagagatgaggtgcagggcgtgagcagaagcccccaccctctggcatgtttgtcaatggcgcttttttgggatcacttaatctctcttttccactcagtgtaaatcagcagtccctaacttttttggcaccagggaccagtttggcgggagatgattttcccacagacagggcaggtggcaggggtgtggcggcggatggtttcgggatgaaactgtcccacctctgatcttcaggcattcgattctcacaaggagcatgtggcctagatccctcgcatgcacagttcacaatagggttcaggctcctgtgagaattgaatgacaggaggtggagctcaggccgtaatgctagcttgcccgccactcatctgctctgcagcccaattccaaacaggccaccaaccagtactggtccacagcccagggactggggacccctgctgtaagtaacagaagcgagaggtcaaaagcaagcggaagaaaccccagcactgctgaccacttcttgggtttgcccggccccttggctttccacaggctggccctgacgaagctggacatcctggacgtactgggtgaggttaaagtcggtgtctcatacaagctgaacgggaaaaggattccctatttcccaggtatgtgaagtggggcaaccgttctgcctgttgggccgtttcatggtattggaatagataggacctgtgacttctcagagaggggtgagttcccacgttcacaggacacagggcaagcagcttgtctccagtgaccagcctccatcatggcttttgcctctcacgggtttctccccacagcgttccccaggaggcctggctgggcaggggtggctgtaggccccttccagtgttttgggaatggctcagggggacagactactcgcctgggaccctgggggaccttcagctgccttgaggaaaaggcccacctgcagggagccacgggaggcacacaggagttagtggatgcggtcggctctggaagatgtaaagctctatgcggacgtacaggatgactatttcatctgagaaaatacgctttgtggcgagatttttaagacctaaccgggatccctgctccatgcaccccttcttctggaaagcatgaaggaggtgccattttcctgggtttcacaggtttcagtttcgtgtgcgtctggatgtgccccctcgacctcggtccagggtcatgttctgaccctgttccccacaatggcttcctcctcagcagccctgggcgagctgctcctggctggtctccactcagcagatctttgtaggccacacagggccacttggctacaggagccatgtgtgtccttgcaggcggtgtccctgaccctcctgacccttgacctttgagaggctgcacttgtgaggactgcaagctctcctcatggtggtccagggtcccagggggacacgcaaacactgcctggctccaaggctcaaacacacttgcagcgagaacccgtattccagcatcttccatctgtaagggtggttgtcttctaccaggagccacagagtcctgcacagggccgggatccctgccctctgggagttgatgctcttggggtgggaggacacagatgcttcaggatcccttagtgcttcaggattctagagtctcagaatttccaagccaaggcttggagtgcctcagctgatgtcacagtggaggttctagcagagtgggtagcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcaggtgggtgccctgcatccccagccaccctccctgcaccctggatgccccaaggggcccacatcccagcgcagggcttggtgagcaataagaaaaccaagtgtggtcaccaagcgaatatattgcatggcaggaggggaggacgactcggagctggggcagtgtggctccgggctagggtgtgggtgtgaccttgccgggagcccctgcctctccgcatccagaacaacagatgggacacatcccagccatatgagtgtgtcatgtttaccctcataacccagaggtgtttgcacctacagagaaagggtctgcagggagagtcactaagtaactaacgttgccatttccaaggaagaagggaggagactcctgttttccgctgcgggaggatcagtcccccaacatgcactaccttcataacttaaaaattagaactgcctccatttggagagaaaatagccccttttaccatttgaactacacagaaagatacgacactaaagacaactttttctgaactttctgcctccagtgtgtatcataacagtcttttctgctctctcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 1313 - DNA, 24253 bp, Homo sapiens
tttgaaaagcaacttttattgaagaatttggagggaaggttccatattatattataatagtaaaaatactaaagttgaatgttgtaaaaaaacgccgtggtgcagcggcagcggcagcgtctggccaggaggcgtggaggggcccagggatggccacccccacagggagtcagggagggcctggggcgacagcggaaaggttaagcgtcgaaaaggtcaagtgctaccgtggagagatcatctgagggggaggctcccggtgggacagtcaccaagaactgtgacacagaaggggaagggggagggctttcctgtcacaaagattaaaaacccccaaaatgcatttgaacaacataatacacaataacaaatttaaaccttgctcctctgtcccactgggtaaaccctggcccatcccccatccctggtcccatcccaggggcccagcctccgatgacgtcctcagagacacggccttagtgctggggggctgctgtgtgcctgccacccccaggagagggtgctggccagcataccatagtgaggttgcatctggtgccaccaggttgaactgaggcccagggccccagagagatgacagatagctggtgacagacagcccagggcggctggctgacagagtgaggggacacatgggcaggacctgcccggccccccaatgccacattgcgcatagctgcagaagtccttaacatttccctacgtgaatcggattgttctgagggctgaggccacacccggagaacaaactggatgaaataaattaaaacccgcaggatagttttcttccctaccccgctgcgggggagggtgctgcccacagcacaaaaacgtctttccatctgggctcgagaggacagcgtggcttctctcaaatgcacccgagaaataaaaaccattaaatacagatcatggcacgaggccgcctctccatccctccaagctatcgtccagcgcagtccaccgccgcctcaggccgtgccgctggccgagtaggagaactgggggaagtggggcctgcgctcgctgtccacacactccatgctgtcatctgtgggtgtagacagctcagaccccggtgccccacctccctgccacctccacccacccacagctccagtaggaagccaacctcttaaagcacggccagcacgctgccatactgccaggaaactgagacagggccccacagattgacacagggacctgggccctcagagcactgcctcccaccctgatcattggcactctccaaaaggaacctttttaaatatttagattttaaaacatctgaagccaaaaaagctgaacactgcaggcctctctgagtgtggagagaaaagggagtgggcgggggcaggcagtggcccctcaccttggtcaggtggtgtgatggtgatcatctgggccgtgaactcctcatcaaaatacctggtgtcagtctccgacgtgacctggggcttgaagggtgggctgagctgcagaggtgggcagacgggacagtcatgagcttcgctccccactcccagcacaccctcaagtgtgctcaagaccttcaaagcacctggatctccaaggggtctccaggcaggactgatgtcagagagcagcaagccaccagccccccacagaggcagctctgggagggagggacatgaggggtgcaggagcacggagacaaccctcaacagctgagacgcaaagctgccctcacagcagccccagcaggcgacaggaggtagtgcagcccagctctgagagaccctccctgctaccaggaggtgataactttatttttcctttttctttcttgttttcttatttttcttattggtcttcttgtaaattgggaaagagggagactgtggaacaaggtgcacaggatgagcccaccctgcctccatggctcagggactacaggaccacagcctgctggcatctggctgcagacaggactctcaatgacccaggatgaagggtgactataaggtgatgtgcacacgtgaggagctgccagagagcccctcaggtcccacagtcaaggaccccctcaagcactgccccaccccagagtctgggctgggcaccagcattgtccattgtcaattagcaaggtctctggtcaaggctgggcagaggttgagcactgcccaggccccccatacccttggagggcagggcaggagggtggcaggcctcaaggcaggaacggggaccaggaccagggcaccctgtgttaatgggagaacaggtgcccagctgggtcccagggctgcccagcccgaccagctgcacacagcctaggacaggcattcaggggaggggcaggctgggaacggggcagaagcacacctggtgacagggcacccagcatctcagagtgcaggcttccgaacccagctggcagaccccatcagctggggtgatggccagggctcctagggtccctgaaagatgagcacccaggatggcgactcatgcagaaagagctgcctccctccagggcggactcccccatgtgccagaaaagtaggtgctgtccctgtccctgcacagccagaaatagggctgggctctccttgcggcagaagggattgaggtcaaacaggaggaactcgtggaggccaaggggcagcacccctggtccaccaccagccagccttcactgcacagcgtcagggaagggaaccccaaggctggcactcagagtgtgacacacctccgaggggaggaggaaactcagagtgtgacacacctccgaggggaggaggaaatgaggaccaggccagtttcctggtggaacccggcagtgccagagcctctgagcaccaggcgctgaggttggtgcagcaaggccctccttgtaccaggactgcagcaggctcctgaggtgagggcgagtgtgtgggaaatctggcgagcgtgccacgtgcatgcgtgagtgtggatatgtggggagcatgcgtgcgcgtgaatatgcggggagcagccgcaccttcttctcgtacacgtgctgccacacgataccggcaaagaagcgatgctgcatgatctccttggcgtcctcggagcccccgccaagcctgcaggcaggaaacaaggccacagtgtcggtaccgccacctgcccaggccctgggttcaggccccttcctcctgtgatgtagggcccgccagacaggacgttccggggccagggaggggagccggtggtgcagcgtccctgagcagctgtgggtagcaaagcaccacagagctcacggcagggcaggggcttcctgagtgggtgggtgcaggctgcagggttggggacagaggcccaactgaccccggcctgcccgccactctgcttgggcctgaggctttggagatcagccctggccaaggacatcaagctttggctatcagtgtagtctgggaggtgccaggaccgcctggcgcaggggcaggtgcagcctggggatgaggggatggaggtgtagcctgtagctgggatgggcggccctcacctctgcttggggtccttcttgagcagccctgaaagcaaggacttggcctcgggaccaagcgtgcgcgggaagcggatctcctccatgaggatgagctcaaaaagcttctcatggtcctggttgtagaagggcaggcgaccgcacatcatctcgtacatgaccacgcccagcccccaccagtccactgcacggccgtagtcattgtcctccagcacctgcacgggtggcagatgggcaggactcggcatcaaggggtgtccgggacactgccgggggaggtgtgacgtgcttggggcacagagaggacacagcattgcgtgtgctcaggacgtggggacgcagcaacgcgtatgcacgcaggtggggcgcacacctcgggggccaggtactcaggtgtgccgcaaaaggtcttcatggtggcaccgtccttgatcccctccttgcacagcccgaagtctgtgatcttaatgtgcccgtccttgtccagcatgaggttctccagctaggggaaaggtggcctcaggtcagtgccgccaggcccccagggccctgcccccctgcctgcccgccagcgcaccttgaggtcccggtacaccacgttcttctccgagtgcaggtagtccagggctgacacaatctcagcgccatagaagcgggcccggtcctcggagaacacacgctcccgggacaggtggaagaacagctgcgggaggcgcaacctgaggcacagccgtggctcgggcctctgcccccatggcctgcagggctggggtttctcagaccgggtctcggcattgcacagggaagggaccagccaccagagggcacgggggcctggaaagtctcagaagccctaactcagcaggaacaagtcaccccacagcaggcagctgcctgggcaggcatcacaccacccacccagcagggagcaccgtctggtgccatggagagtagccgaggctccgggaaggaccggccccaccatgggcggcccacaggccgcgaagtccatcccccgcagccccagcccctacctcgcccccgttggcgtactccatgacaaagcagaggcggtcgtgggtctggaaagagtacttcagggcctgcaaggaaggggagctggaactgcggccccacaggcaggacggcagccccgcaccacgctgcccgacaccacgctgcttgataccacgtcgcctgataccacaccgcccgtagccccacaccacactgcccgacaccacgctgcctgataccacaccgcccgataccacactgccccacaccacacaccccatcacactgccccacaccatacacccccacatcacactgcccccatgccacgctgccccacaccacactgccccacaccacactgcctcatgccacgccaccatcaggctgggccccggcagcccctgaggtgccaaggagtgtttgaaaggtgagcaaggtggcctgggctcaggtcctccagggtgagttgggacctcagcaggggacagtgctcccagcaccagggccttcgcaaagggaggacacaccctcccaggcgagacccaccctcccgccttccaccacaggcgactgtgcttttaaagcaaaggccccatctgcaggagaatcgtccccaaacacagtgacctggaactaaccaagtggctggaccctggcccccttcacagtaaatacctcctgggccaagtccccagaacaggttctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccctcacgtgcccaagaagacaggacatcgtcccctagagacagccccaggagtcgctacctggccccagcccttcagccccatctgggctcccactcactgtgaggaaggggtgcctggagttctgcaggacgcggttctcggtgagtgtgtgggccacctcgtcctgtaaagcagggctgggtgagctgccaccccgcaccctcatctccaccctgccccaccgccccggccccaccttggccacgatgacttccttcttgaggatcttcatggcgtagtagcggcctgtggccttctccttcaccaggatcaccttgccgaaagtgcccttgcccagcagcttcaggtactcaaactcgttcatggtctatgggcaggcaccagggtcagcaagcggcgctgccaacagtgcccagctggtcggcatgcgtggggtggcatgaggggccccagagtcggaggcagagccaggagaggcgtccacttcacacctggtggcctactgggctcagcggggagtccaggcttacagggaacacatggctgcggccccagctcagagcatggggttcagggaagggtggggtaacattgcccaagcctggcagggctcagcaaccccagttttcctctgacatggggaagaggacccacctgggaagcagctgcgccctacatggaaaaccggcctaggtggagatgccgtggagtgctgagtgtctcctgggccgagctgggaccccatgacccacccagccctccacagtccaaggcagccccaggcacaggcagaagtggggacaggcctcaccacgcggtgcttgggcttggccagggacacctccatctcttcagcccctgagttgtcactgggtgagcccgaccggaagtccatctcctcctcctcctgcttcttgaggccgtcagccacagtctggatggcggttgtccactcctccctgcaggaggtcaggtgaggctgcaggcctgtaccagatcaggagctccaccccacgtctttcacccacccgccagcctcacaagcgtggttccacagctgtcggggttcccagagacagccctgaggaggccaccacttgacctggtctggccacatacactcagggtcacgaagccctcttggacgtgggggacacccaggcttagccccccagcaggactctgtccccacaaccggactccaacccccagcaggactccgccccccagcaggactccgccccccccaagcaggactccgcctcccaagcaggactccgccccccaaggaggactggccctctccaccgggtttttctttttttgagacggagtcttgctctatcgccctggctggagtgcagtggtaaaatctcggctcctgcagcctctgcctctcgggttcaagcgattcttgtgcctcagcctcccaagtagccgggattacaggtgtgcaccaccacacccagctaagttttatatttttagtagagacgggggtttcaccatgttggcaggctagtctcaaactcctggtctcaagtgatctgcgcacctcggcctcccaaagtgccgagattatagacgtgagccactgcacccggtccctagccagtttttatctccagcctcagtttccccacccaaaccccacaggcaggactgggccagtttccaaactgggctctgaggagggcctgggagcactggggagtgaggatggctacaggcagaggtgccagcaccccgccatccccgtgtccctcctaagcgctggggctgcccaagtgcctggcctggccgccacagcccacgtaccgctcctcaggagtctccacatggaaggtgcgttcgatgacagtggtccactgcaggcagcggatgatgaaggtgttgggccggggccgctccgtcttcatcagctggcactctgcgggcaggcagagcctctgtctgcgtgcatccccctgcccctcccagggccctcaccacagcccccgctgcaccagccagctccccttgcataccacccaccaggtcctgggaagccccatctcttcctctctccaagcctcagtttctcgcctcacagagtggggctaggacccctgttccagctcagacactctactccaggctgaggcagccacacagggcatctggcccggcgtcaggtcaaacccccaccatcgtccactcctacagtccttccttcagtctctgagccccgccgtgcgccaggcctcagaggatgaggggtatggagatcccacagaggggctggcatgaggggggcaccccagaaacctgcttgtcccacctagtgtagaaatgtcctgcttttttcccaacctcaccctgagtacctgggaaatacagccacctggagcacacccacacctggggcacacccacacctggggcacaggcacacctggggcacagccacacctggggcacaggcacacctggggcacagccacacctggggcacacatacatctggggcacacacacactggaggcaaagccacacctggggcacacgcacacctgaggcacacacctggggcacacgcacacctgggacacagccacactggaatacacagacatctagaacacatctagacacctagccacatctggggcacacgaacacctggggcacacgcacacctggggcacagccacacctggggcacaagcacacctggggaacacatacctggggcacagccacacctacagcacgtacaccctgagggctgtgggaacgtgcggggccctgagaggtgtgagtgagtggagtgtgtagccgctggggctccgtggcaggctctggcccagcctgtgcaaagcaggaggaggctgaggggccagtggggggcctctgacattccagcatcgaggccctggcaaccacaagggggcctggccaggcagcaaggaagctgtcttccaggcctgggggccaggagggggctcgggaccagcctggtggggagggtggcctgtgtcaacacaggccagagaagtggaaaccggtgtgaagccccggcacacccacctcccactcgctcctggatggtccgatctgccccagtatgcaatccccagggccagagtctcgagcccactgccccggaaccgttccccggagaaaagccccggacagaggcccagcacagcccctggcccctgcccagctctgctccttggccaggcgctccaggccactcacctatggcctaatctgaaggccccagccttgccagctgctcaggcaacacctccagctggtacccacccgtgtgcctctccagagagctccccacctcgttccttcccaatgcctcggcctggcgagcacacccacagcacccacccccagcaaggccctgtcccaggtgccaccaggcacgctgctggcacccagcctctccctgatccctgaagcccccagccccaaccgaggagacactggggagggtgtgggacaagtcacagtgagtctcctgcatggttacgaggctgtcaggagacaggggtgtctgccttcctggtctcccctcacccctggggtgccctactctatcaggctgccctgctactgctggcttgaggctggaagagccagggaaggagacctcggcttacaggaaccaggtcctggtaaaccccaccccaaccccagcccctcagcctggggctttgcagggcaaggcctctgcccctcccaactagaagcttcagggcacggtttgctggccacagaccacctagcagccagggtgccagactgaccccacctccccttatacgtgcaggcaccaagggtgggagtccttccctgcccagcctggggacggattccctgcatttaacctcctcccagaccctggaccagaacctgggggtccagcaagttcaagggagtcggaggaccgcaggcctcaaagaaaggagggcagagctacttggaggggaggggccgatgcagcacatggggatggaacctaaggccagcccctggtgggcacctcgctctgcaccacagacctgcctgagacagatcccagaggcctgcagttacccagccctgccacatacagatggcccacaactgggccctaattagccactcagtcacacctgcatgcccaacccgtgtctctggctgccacaggcagagctgggctccaggacagggacacagaaaatggggaccatgctgggaggcccacgtgtccccagcctcccacctagcagggcgcctgggtctccatgccagggttcccgtctgacatgggtagggtcgcacctgcccccgctacaggtaaggaataaagccacagcagggcggagcagggagcgtcacatgtctctcatctctgtgggatgctccggccaaggtcccccgctggcctttctgcacctgcccctccatgggcaaggaggcagcctcacagaggggaagcaaaggctctgccatggggtctggaggctgagagcctgtgcagggagaggcacgagctcttcctcgagtgatggaggcttcagagctggagaccccaatggactcttgccccctcacccaaggggtttcccaaggagaggccctgatgggctctatctaacccccttggaggaggggcccccggggcagctgtccaccctgagactgggctctgctgccacttgtccggaccctccagcttccagagcatgggcaccagggaactgctccagggtcagccagccttgggactcggcccagagacccccgcccagccagcctcggcctcaggactctgcccagaaacccctgcccagccggcctcggcctcgggactcagcccagagaccccggcccagccagcctcggcctcgggactcggaccagagacccccgcccagccagcctcaggactcagctcggagacccctgcccagccagcctcggcctcgggacttggaccagagacccctgcccagccagcctcggccttaggactcagcctggagactcccacccagccagcctcagctttgggactcagcccggagacccctgcccagccagcctcgggactcggcccagagacccccacccagccagtgcttgttgcttgccagcccaggacttggaggctccaggggacccccatcgtggggcctggtgggcaaagagggctccagccaaccccccaaatctgaatcccgagaggccaaggggatacttacgcgccacagagaagttgttgaggggagcctcacgttggtccacatcctgcggccgctccttgtagccaatgaaggtgccatcattcttgaggaggaagtagcgtggccgccaggtcttgatgtactcccctacagacgtgcgggtggtgagagccacgcacactctacccgtcagaccctcgccaggcagccaggcaggaactgggtgtgccaggacagatgtgcctgggatgcctgagtcccagggggcaggcgcggtacgggagctgtttcttagggccagcgacagaaacggccctgggtcaacgggaaggcagactcgccccaccacagcgcccctctcagaagagccaccccgagctgtgtctgaaaacgggctgggccagctggacgcaggggatggagtaccatggacaggaggctgggaagaggtctgggccagtctgcacagccttcctggaggaggcagccctaaaccagccagtccccagcaggcaccagcagcagctcgggccccagctatggccacaggggctgcggggctgacagcattccccaatcaaccagggtcggccaggtggcgacagcaggtgacagtggcttgtgtgggctgcccagcatggccgccccccccgccccgccgccacccaccaggaggatggagcatggcgtccacagttagaggtcagcaccactcagactgagggccgggctcgcgggacaggactgcccactgccgtgggatcgcactccctgtctaggggcctggagcaccgtcttggggactgccgatgaagccagacacggaggtggcccagccagctgggcaggggccccagggcacagagggtgccaagtccccaggctgagacccacactcaggccctgccgccgtcggccctgccgcgtcccacccgtgggtcattcaggtacacgggaacattctccctcaagttttgcagcatcagccgtacgcaggcgttcacacttcagaatcagagcagctgtcctcggtgatagcccagcaagtaccatttttcatactgacactcggaaaaaaatgttccacttacattttgccaagcaaggagtttgaacaacagggaacttactaattaggcaactgcttcatctgaggggtcactgggcaggggttagggagggggccagggtaaggggttggggtccctgagctctggggcctgggttttcatgccacactgagccccagacagggacacctggagggatgtgggggacaagcaattgtcccatcaccagaccacccaccacccagtcctgctgggtcttcgtggtgagcccagacgcgtccagccctccctggtgcacagggaagtcccagcagggcagcagccccaggggagctcagaggacatgggtcatgggcatcccagcaggcattctactttccagggagccacgggggagttctttaatagaggtgagccaccaaggctcgacacatggccaccccccggccaggtgacctctccctcctaccccggccccagctgcccaatgcccttcccaccagcaccacggggcgtggtctccacaagaccagccctctctctgcccaagccagggctgctggggggatgctggtggagggtggggacaccccacccagcagggcctgagtgtgggaagaggctgttgtcaggtctggggtggaccaggaaggggacagccacagcccactcatagctgcctgacacctctggaggacggccaacacccagttgcagggaggatgatccagggcccagaatctgcccctgtgcccaagagcactcatcaggagaccccacccactccgcaagccctccatgcccctgccagtgggctgccgagcaggcgtggtcctgccacccttgggtgccggctcctgtccctgacctgggatctcgcacacccccgagtgtgcacatacacgcacatacgtgccacgcagctccaccccgcctcccacgtcccctcccccagccacagggcccctgcaggtgcagcgggcaggcaggggcgctcagtgagagcagagcaggctcagggggctgcatgcagcccaccccacccgtcccccatcctgggccaccccgctgctcacgcccacccgcctgcatgccagtctggagctgtcggcccctgatggagtgcctcccatcctgccagctgccactccccgggacgctaactgagcgggaagactgatgagcgcccaggcccggcacccctgaaacccatcttatccaccaactgctgccagcccccaccgtgcccagcatggccccgtgctgcccccgagcacgcagctcccgtgcccaaccccagccttgcccctgaccctgctgccacaagcccagccccaggttctgtgagctgcatctggggggttctgggagctggatctgggggtgcgggaggggcaggcccaggggcggcgcttaccaggcgtggggggtgggagaggacaggtgcccagccccgagcattcctggggagtcctgggatgggcagaggcccaaatgggccctgggctttcagtgccttcccctcgcctggccccacagacccagggaacagacggcgatcagggcctaccccaggagacgggtgtgagtgaaggggcctcacgtggcctttgtcttcggcatcccagcccagcacacagacccctccaggggaggagcaggatccccagggacccggggtaaggggtccagagacacacagttctctttcttcatctctcgcctagagggtcagctagaggatcacttgggggggtgccagctgcagccagggccgtggcgcgcatcttaacgagttcagcccagacaggatgctgggtgggcggccagccccgacagcagatgcggcagggccccactactccctgatccaggactggggtgacacaggacggggcaggtggaggagacagccacccggggcccagcatcactgtcctcatggccacaggacgcctgcaggcctgcacctgcctactccgggtccctcaggagggtgggagcacagacacatcagccagggctgccctcccagacccctcacacaaagagaccaacccacatggagtcttctccttcactatcctgagggtccccaggggaactggaacctgtcatccaggacttaacttgagttccccaccctgttgtggtcctcagatgccccccactcgaggcaggagtacagtccacttgaagagtggcctctcaatccctgacaccccaggaaaagtgccctgcattgctgggggaactggaaccaggcagtagggacctcgtcctccacaccgaccatgggaagcacccgccacagaggggccttccatctccccaccatcagccagctggcatccccccaccccaccccagtcacccccccaacaccaccccacccacctgcctgcacagctgagggcaccaaacacagagtgggcacagacccccaggttgccacgccaggccctcactccagacgggtacaggcaggcaacaaatggggaggccagggcacgccccaccccacacacagccagagtcatctcctgccagcagccactcccaagggcaatggagaccgcccagcattcaggcccagggggcctcttcagtccctaactctcacacccccatgctgggctcaagaacccccaagtccccacccgctgcacatgtttcagacccgggacctggagcaggcagggtcccagtgcaaccccggcctgggcctcagggtctggcagggaagacggctaggtgccccttcagaaatgtcagcaagtccggatgggggaccccacaccactgccagaagacctgagtggggggccgagtggaggacggcactggggactggtcccaccttcctgccccatggctggtcccctgggcaagggggaagcagcagctccggtcccaccctcctgccccatggccggttccctcggcagcggggaagcagcagttccagtctcaccctcctgctggccccctgggcagtgggaggcagcagctccggtcccacccttcagggttctctcaaggccagccctgggccaggtgggagccaccctgacccttaaccctgtgacactgcacctatccaagaccaggtcctgtgaagccacaagggcaggggctcctgtgcctgatgaaacccgtaaccctccccaccagccagcacatccatggcccagggctccaggcatgggaggtggctgccctcggtggggggtaggcagttggccagactcctgtccctgcccggggggacagcggagaccaggctccctcgactcctcctgcacctcctgggccccacacaaccccagccctggtccctctggcatcccgatgtcccgggtggccctccggcaggagtgaccttccatccccaaccccgctcatccccaggaaggggctggagcacccccagggaaagagggttccttcccagaagtcctcctggaccaaataccggggttctgagaggaagctgctcctgcctggcctcccccaacccaccccaccaccaccacggggaccacatggacagtcacaggcagcccaccctctccacgcctcacacacgtgtcccaggccacactgtgggtcaggccccccaaagcggcacccacttagacatgggggccaggacccacgcgccatgggcaggactgggtgggcccctgagggccagctggtggccctccacgtcccgggactgaccacctcctgagccaccaggtgtgtcagcccccctaggccaccacgtcctcagctccctgaacattctctcaaagtccccagttctcaggaaactgctggataaacacttcgcagagacggtggtggcagcggctggcagggtgccaggcggcaccgagctgcttctccacagcaaagtgagcccagcaggccctgggagcgggcgccagctgacagcggccaccgtggtccccactgccgacacatccatcgccccgacagctgccgggggcccatttaccttctccagcacattgagcagacggctccgctgacggcagcccatgaggggcccgcaacccaccctccccgcctgccaggagaccgcacagctcaccgcgaagggcccggcctgccaggcctctgcccgggcccgggagtacacacccctttaccagcagccctcgaaccctgtaaacaaccaggctggggtgggggcaggggaggggccacacaacggaggccagctgaccccacttggctggagcccccaggtctgtgggtgaaatacatccactgctcctcccggcacaagcccttctgagggggcacaagtggccagtctgcacaaggagaggtgtctgttcccgccaggcagaggactggcgctccacctgcctgggcctcgcccagcccaggacccattctgctctcccagaaagcccaccaggcaggcagggcgggcagggctcatcatgcccatcagctccctgggaaaacggagacttaggggaggtgaccctcagaggcagatcatgaccagagagaccccaggtcctgccgccaaggcaggggttgtaacttgacacaaactgcaaattcttcacctccttccgctccaccatggagcaggcctcagcccgacacacacaccccgggaggaacatggtgcgggcaggcggcaccaccatgaccccgtccacctcgctgaggcacagccggaggcgctggggcctctcttcctgccactccagggaagcacctgggtctcagctttccattctcctggggctctactgggtggggtactgggcctccctggtgctgcccctgacagaccacctgggcctggatgtcctcccccacaggcactgcccgtcacccacccctcgggccggcaaaggcaccccacctgccacacacccatccatcgcagagcccagcacatcccaagaccctgtccctgtccctgtcccccacctcatttttggtctgccccaaacaagccccacccatgtcatggcccaccctgcctactcaggacccctgcagatgaggctgcagcccctccctggcgcctcctactctgcccccgcccactctccccataacttgcagcaggctttgccaagtgccctccacccagtgggttcccagggccctcaccctcgctccctgcgtgggaggaagctgggcatggggacagcacacagtgcctgctgcgagggagggctggccacagtgtcccacgtgtagacactgccctcgggaaaggaagtgggcacgggcacaggctccttccggggctcggccgggggcacgcagccatgcccacagcccctccctcctcccgtctctcttgggcagggcccctggcggttgaagggctccagtgctggcctctcaatccctgacaccccaggaaaagtgccctgcattgctgggggaactggaaccaggcagtagggacctcgtcctccacaccgaccatgggaagcacccgccacagaggggccttccatctccccaccatcttgtttctgccccaacttggagccacgcctggggcaggagggcccccagagcacggccagctgtggagggtgctccttctgatcccccggcctgctgggacattgtggccctgacccccgtggcctcaccccacacctcaccaagcttgtgcagctcagcgtctccgcgccctacacctggctgctgtgcccctggccccagtctgtggggaggccagccagaccctggccagccgaagggcctctctgcattctccaggcccagggagcagccacctccccgccaggcctgcccagggggtgtctccacccctgagctggacaaccagctgagggcctgggcaggtgggcccgccaggttacagggtatgggtggggtctgcagtcaccgggcccgcctggggggtgtgtgagcccaaacacagcgccccaaggatcccaccccaaagcccgcaacattggcagcagagtcacccatgaactcccaaccccctcaattccaacgtttctgaaatccaaacctatcattccttaaggttcaaggaaaacacacctaaaggcggcatggcagggaagggaactcccgttggagatgaggaagtaaggggcctagggttcgcctaacagccccatcctggcctggagccccagggccctctgccaacctgcccggggccccagcgctgggctgggggaaccttctcctgaggccatgggactaggcacaatggtccaagcagacagaagcagcaggcagctgcccacccagggtggcctggggagcaggcccagagccacagccacagccaccagtctcagctatgggagggcccgagggcagggtgctggccccaagccgggccgggtgtgcccaggcagaggggacgccagcgggggccgcgccagttccctccgctcagcctcgtgcaggacttctaggaacccggcctgatgcaacccggccaggcttctcctgagagtggaaggtgtacgggggtctaggccccagcacaggaatcattccacccacattctgtccactctcctgggcctcagtttcccttcccggagtccagccccccacagggcatccctgcccagagagggccagtgaccaagaaacacacaggaagaagagctgtccactcaggagccaccaggcgtgggggctaaggtccagggctggggccagcagtgacccctcacccccactcaaggccacctcggcttcctcttttgttgtttttgaagtgagaactcaacaagctcccaaaacaggaacctccctgatgctggcggcctccaccacagccatgccatgacctccaccagcctgtgcctcctgcccctctcccgggtaggcccagggctgttgggacccccactctctgcccagccctcccaccaggagccagcacacttgcctccccatctctgtccctggcctgcccacgggggccgttccagaccctcaacgctcccccaggggaggcagagcttggcactaaccagcccagggcccgcgggtctcacactgaagccacctagacgcagcctggggttgaccctcacctgacagcctgggaaaaactgaggcccaggaggcacaggcagccctggcctggagcccaaaggttcccacaggctgaggggagagtctgcgggctccctccctcagggtcctgctgggcccctcatcctggcggggtaatgagcagcctccatctgcacacaaacaattagccctgcggggccctccgcagcagctgctctctggagtgggctcagagtcccccacagacctcttctcaagggtgtttactcagcaaagccaaggcctcctccaggatgaaggggagtggcctgtaccctctgaggtcccccacctcacgcagggaccccaggaccagctggatggctgagcagcagctggggatgcagtgaggttctatgtcgctcaccaaagcgaagtaacacactggggtaggaaccactctctccctgcctcagtgcccccccgcagggacagccagtgccaggacttcaaggcggggagagggggtgggaaggaggcccagcctaggcacctgcttggggtcagagaccagcctccatactccccaccgggacgcctggggctaactcagcaggagtggtgagggggctgccctgaggcctggactggggggtctatgccaggcatgggcccggggtagggcatggcaaggactcagatgtccggagactggaccctccgtgagccgcatggacacacggtcccgtgtcacccgggcccggccaggcacccagatccgtggcttggacacgctgcccacacactcaggagcgtctgccgcgtaacccacgcgccccaggcagcttccctcgacccccgcccactcggccttggcctgctgggtcacagcctgccgaaggcagccaggcctgcagctcttccccggcccctctcggacagcgaccagcctgagggagtccaggtggtgcccctgcggccggcacccactcctggcctaggcccagccctttctcgagagcccagagcacctcatcctgggtcccagcatcccggccacccgcctcggccctctcctgacccacttggtccagccatgtggacggggggacgctcaggaagacagccgcgagtggacaaaaacaggctccaggccggggctgcaccagggcagctctccacggggctaggctgcagccaggctggtgcacggccccaggagtactggggcaagcgggcaaggtgagcaagctgtttggggaaagtacctcaaaagagccacacagcctctggccaaagcctggcacggagctatcaaaggaaggaaaactgcaggctggaggccgagttcagccagacctgcgccctggcccaggattgattttttaaaattgtcagccttcaaaaatcaggagacttcacacaacagaacaaatctttgaaaatgcaaacgtctgagcaacactgagcccaccagaccaccaatggccagagctgagctgggctgcttatccagtgagacagccgaaacaggaggggacatctggccccctgtccctataggccccaccagcctcctcactagctcctgcccttaacagcctaagctcaccctccaggaaccatctccctgttagatgtgcagacccagaggcctcgcctgggtccagccacaggtccacacaggcctgcagccggaactcctgtgtccccatgcccggtcccttctgtccctgaagctcctctgactcagagcacacacatcagaacaacagaaagcagcctgggccacttcccagagatgacgctcacctcccaaggagcaggagaaggagcctgcagacactgccaccccacccctcacacacagggcatacccgtcccctctcatctcaatgaccacatcacccctgaaggcaccatcacgccacgtgtggccagcccaagtagccgtggtgggactgtcacctggggattcagctgagaaccaaagtgccccaggccacggtcgtggggagtcccggcaaaggggacaggtgcgggccagcctctgagacaagcaccctgacctgcaggagcaaggctgggggggagtggaacagggcgtctgcaaggggctgcggccgggcctggaggacagtcactgcgtccctccctccctccccacccccagccaggcctgagcactgtgaagcacgggtggggtcagcccagcacagccctgctagggacaggaaggcagctagtacctctaaccagtgttgcgggtggggctggccctgccaggagggtggcacagcacatctgcaagacacacaggggaccccagggacgggagtggcgaaatgcggcaggccccggaggacaggctttcctccgcaaggagcggccggccatgcgggtggacgccacctgctctcggcaacaagaggggctatgcctgccaagggcatatgtcatatccacgccacctcccatcctcagcgcccactacactggggatggaggaggaagagccgggggtagaggtacaggaccctctctcctggcctgaggctaggggccagatgacagagcccagaggctgctgaggctggccggaccccaactcagggccgcccacaagccattctccactccaccaggtctctctcccaccaccgctccctggtgtagatggggaaactgaggcccaaggagctcaatgaccttgctcttggaaagggtcatggcgatagagtggctaaccagggttcaaactcagctctctggacgccccactgggcctgatgtcctgtccctgccaggcccctcctgaaggcacgacatcagcagcagcctgaaaatcacctggcctcgggggagcactcctgcctaggcccagctggctgatgggtgccccagtaactggggcctgggcccctgggcagtcaaggccctggcatctcctgggtcagcccgagatccaacagtctatcaacaaacacacatttgccaaggataaagaagcagcggccccaggcagcagactatgtgacacagagaggaacagggccagggtcggggcagggggtccctgacaccaaagagggctgtgaggtgaggagaggacctccaggcacaggtggcaggactcctggggaacaagcaggggacagcacacggggaggggatggagaaggcaggatgcggcaggaggccttggggggaagcagagccagaagctccccaaggaccacaggcgtctgcagcctccttgtcttcatctcgaggccccgcgtgccatcactggtagctgcccactcaaacactccaaacacacagccagccacacccctgattcccccagcatctcatctcggtcactccttcaccccacccccaggctcctgtggctccttaggcctgctcttctgtgagctcctatacatcccacaatgccccatcttgtgacacctacttttgccacacctccctgtctgctccagctgtgtttggggtctccccactaccagatgtgaaacccatctgctagagggtgtacgtaaagccggggggctgctggcatgagatcactagaacttaggagggaacaagtctggaaaaagaagtcaggagagggcggaccgattccgcctggggcagaagagagtgacttggccagaggacctggacctgaacaggaagcccaccctagcaggacagaggagcaaaacagccacccagactccaccgcaccccgctgagcaacggagggtgggtgaggcagaagggcctgcacagggttggaaggggtggggctatgtccccagctcccatcccacccagctgctggccaggcccctcgggcagcacctcctccataggctgcaaggccaaatgagtgaggagggggacacaggggctgggggacttggctcagccagctctgcagctccaaggcaaacatgccctgtgcccaggcggtacggattccccccacccccaaagctcaggcctgaagcaggcaccaggccaagccaagcagccctgccctgccctcaggagcccttgggcagtgccctgggccgccagcgtgccagaccctggaacagcccagtgtcctcgctgccttccaggaaagccaggagagaggctggcagcagctcccccgcctgccagggcccacaccaggaagccactcagatggccggccctgcacagggcctcatcctcctggcctccccgaggccgtgccctccatgccatgggaagacatggggcccaggacactcaccctaggccagcccaggagccccaggggaggcagcccctcccacccagcagggcacaggcactcacagaccctggggctactacccccatctctccctccccaggcccagccctggcagcgggtactaacctcgtttgtgcagccaaccctccttcacaatagccacgtcgctcatggtgcccgaggctcccgcgacgctcacgcgctcctctcaggctggcgctccccgagcccagctggcctggccacagcctctgggagaagcaaaggaagctgaatgtgaggccacgcctggctaagggcagctcctcgccctgggtgagccagagacccactgcacgtgcctgggggctccacccgcacctgccttcccaggtgggctgccatccctctaagctctctgacccccatctgcccgcctgccttccctctccccaaaacactcagggctgccaagtgtcaaatccatgtaattgaacacagttccctggacctgggcctctccttattctaggcttagagcctccagcccctgccaccaccacccgcaacagccaggccctgagagctgctgccttgctcacctccccattcccacctcccccagccgttggacaaatcacccccatccccaaaaggccttcccagcctccctaacctgatgcaccagctgacaggctgcctcctccaggcagcccctttgacttctttgacccaggctggctcggccttccctaagcccctggtgacagatggccccgtttgctctccctgtccatggtgttcctacccatggatcctgggacagggcacagggctcctccctgctccccagactaggaaagcaaagaaattcaaacatgaggaagacaggaccaggatgcaggccactggcgcaaacgggagtccagagccctccagcgcaagcccaaaaacctcctgggagaaaccccaggcccctcctaaaccacagcgcccctgccggtctgaatctggttcattcatttggccaacatgtaccgggcgtctcaggttttgccaggcccagtgctgggcgctggagacaaagagaggttcagacaagtccgtcagtgaggagcacccagtccagggtggttacagacccataatta

SEQ ID NO: 1314 - DNA, 6528 bp, Homo sapiens; identical to SEQ ID NO: 1311

SEQ ID NO: 1315 - DNA, 23115 bp, Homo sapiens
gctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggtgcgggctggggcgccgggtccctcccccaccgcccagcgagcccccctcccccgacccagacggcccctgtcctcccatgccctggccggtcactcacccgcttggatgccttccttccgggagcacctttcccagggccaccccacccacgcacgcacacgcaccactcacacaacccccgacccacacacaccgccctccttccacccacccctactccaccaccccggcagcgggccagggcacagctataaatacaagtcgctgagttggggacacccgatccttagggggtggcgcatgccatgggtgtgacgctggaccctccatgggggaaccagaggacccagccccaggatggtttgaggacccccaagacaccccccttcctcatttacagtgatcacctggggcctgtctgggtctgggatagggcttacctggctccccgcaaggtctgcaggtggtggagggggtaaaagctgcctgctgggtgggggtgaccccggtgagtcagccaaggagaggcagaggtggaagggggccaggccgtcctggggggcaattggggccgcgcctgagggagggtgcttgggacgatcctagccagacatgggagagggagggccacagacttctggccagggtgaccccgtggctggcagtgccaccgaggaggccagacctgctttgtcccccagggcccagggctgggcctctgccagccggcagctgctctcagcgcccccatctgttctgactgagctgcacactgggcactctctcgggccgccaccctggggctacatgccccatgccagggcagccaagtctgctgcccatgggctgacttacagctccaggcacaaaggggtcaactttgggatgcacgcgtctggggtttggagcctgcctggggctgctgccaataatggaacaagggcccccgcaccgtcccttctccgggttctgtggcctccttcctgagctccagagaggagggctggggcccaagacgaagggagtcagcccagcaccctgtgtggctcagggctgtccgagcccctcctgccggaagggactgtggcttcctagaaagttcttcctggaacagtgggggacctccccccttgctctccgtcctaagcagcaggcaagcacatccctcgctccagagatcccccaggtcctagaggtggtcctcagcccatgctccctccacactgcctctgccccgccaccttgtcctgggccgccagggggcatgtccagcgctctactgctcttcaccctccagggcgccctcagcgtggggcagccccggcccctgaccctccttagacctctctgctcccgtgaggcccaggcccctccctatgagctgccagctctggtgggcgccatgcacttctgcagggcgggctggggcccccacaggtgctgtacacagcattcacctggctccgcgctcccagctgtggagatggttctggatctgggcactccctgctgtgccccccacccagtccccccacagccccgctcactcgcagctgcacacgggagcacggaggatgcagcaggctggagcccatcccgcactccggccaccaggctgcccccgccaggccacccccaccaggccaccctatagcctgagggagcccctggctctccaagtgagtgggaataaaagaggtttgtccctggagcccacacctgtccccctgcagcctcctcacgagccagtgaggcaggatcatcctgaagagctccttcacaggggaacagaggctcaggcgtggaggaatgagtcactgccacatttggagccctcactggtgccacgtgcccaccatgatagcccagggcctggccctttgtccccacctgcgagtgcggggaccgagctggatctcagcggggcgccgctctgcaagggaaggtcagggactggtcttctttggggccccagccccaggctctctgcaagtgctcagtgacccctacctcacagtgcccatctctcctcctagcggtgggggttctcccctaccaccgggctcccagcacctcccctgttcttgtgcacaccatgtctgaccaccccatgtcgtcagaggctggcagagggtctggctggatctccccagggaagactgcgtctttcttacttggagtgtggatgcctgaagccagatgaaggtacccgacatgggggtctccaggcgcacagaggccaaacctcaccctctcactcaaggggctgagcagaggacagagcgagggccgagtggtccaggtggtcaaagtgcacgccgtgggcagagcgggctgggccgcatctgggaggcaggctggctgccaggagggctgaagctgccagccctggcaacaagcctgttctgctccccagtccccaaagggtcacctgggcctggggccaccctgggttttggctatgctccttccctggctgcccaagcctctggacacccaggctctggctctgcctgctgctgacgcctgcaccagcagagccatcacttcgagcccagctctcaagccccctggtggcccctggcacttggcaagagttgctgctttgctcaccctggacatggactttccactctgcccagaggtgatctggggctgcccaaagccccgcacggctcgcctcattcttttcccatcccggtggtttggggcctgtggtcagagtgcatctgggggcccctgagagtgtcgtcacctcccacagcctcccgccttgggtccacctttaggacctgtttcctgggcggcctcccttctccaggctgagcctacattttgcatcccccaccttctgaccacacccccacctcacacctcggctgtctttcctccattccagggcggctctgggtctgttcggctgcactatgccccctggccccactatgccatcttcctccttgcctgctcccctggctgcttccaagcctctctcccctccaggctgagtctcctctgagccaggtctgccctccctgctctgcggccacatcacatcgtctgcctgtctgtgctggggtcctgtgttccctctcttctctctgggcacggacaccccatcctacttccgagggggtccccaggtacctccgcctgtgcttcctcccttgcgtccatggcgtttccttcccctgcgtgctgtccagctcctacccctcaaatgggcagctgaaggcaggtgcacctgggtctcccctgccccctgttcccaggctggcagtgcccggccttcaccccctagttcctccttccatctccaagatacttcctctggataactgggctccctgccgaggaccacagggctccagcgcgccctggtcagggtttagaatccccgtccttctgctgcagtgctgacctcagggcactgggctgtttatgtctggccatgcccagtacacgggctgaaggggcctgccctgggtctccatagcgcactcccagcctcccgtgccctccaggtctagctagagccagtgtccagccagcagacgggtggaaagctatggccatgtatgcaggggtgtgagatcacagggtgtttctctgtggtgtggcagcgccaggtgggagctggcatcctgtgcattgagggcccctgtgctgtggctgttggggctctgggcaccctttccaaggggccatcaggtaacgctttgccttaggctccagggtgcaccagagaccttctgggagtcagaggggcagctgccttggccagggaatgcctggggttgcttccagaaagaggtcttccccctaccccacctctgcactgttgatggtgctggttactgggccgtggctccaggacagagggtccctgcagttacacacagccctgcctcattgcaggaacaccagtcccgggcagctgagacctgcacacctgtagcagtgacctcggttctgtcccagacctcaccccactaccaaaaggggcagagaacaattcctttgggttgaaggaatgaatgaatggtgggagcctgcaagcagagcccagaagggagtgaagcagtgtaagtgggtgaacccactgcaccacactggtagtcacaggtgtgtgcacactgggcgccagggccccttgctctgtgccgggcacagtcgtcgtacaaactgccattgagtgccagtgccaagaggttgggcccaggagcctcacggcctctgaaaagcaccgccggcctccccctgcgcttgccactctgctgccttcactgcctggcgtgagctcgctgacagccaggccctgggccagggctggggatggacacagaggcaggagagctggtcgctcccattccagggggagaggtgcaaacagccactccactgtcccctcctccccaagcctgcatgagagctgaaccaggaggtggtatagcatgggcctggcacagctagggccgagggggaagcgggcagagtgcagtggcgttgaggcacggcgccgtcagacatgcagtccgctaacgctgtggggaggagaaggctctggagcatgggaggtagcgagcctcgtccaggtgttgctgcaggtagggctgacgatgggggctgcattgcaggggagaaaggggcctccttgggaaccctgggccaagcagacgctgtggccagaggagtcatccatggcagtaaagggcctatggactgcagggcagagaagggcagtggcaagtgggccgggagtggagggggccctggcaggtcaaaggaggtcaatggacagcccccaagccaggcagatggcaggtggcatcccaaggatttagggacggggtggacaggagcaggacgatggctgcagggcaaggctgggacccgcacgggtgacaagctcagtgcaggggcagggcatgcgccatctgggcagtgtggaggtgaggagcaaggacaaagcctgtgtgtggagacgccttgcacgtgtcagcagcatggcgtcggcgtgggagggaggaggtagcgtcggcgtgggggaggagcgtggcgtcggcgtcgtggggaggagcgtggcgtcggcgtggtggggaggagcgtggcgtcggcgtggtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtggcgtacatctgtaactccagcactttgggaggccgaggcgagcggatcacttagggtcaggagttcaagaccagcctggccaagtgaaacccggtttctactaaaaatacaaaaattatctgggcatgctggtgggcgcctgtagtcccagctactggggagggtgaggtggtagaatagcttgaactcaggaggcagaggttgcagtgagccaggatcacaccattgcactccaacctgggcgacagagtgagaccctgtctcaaaaaaaaattccattgtttaaagctgtccaggctgtgtattttgttttggcagccctggagactatagatagatagatgatatggagagaggtgtagagagatatttacttataaatatatgtacatatataaaatgcctggagggaccagcaatggtgggaggactggggagtggccccgagaggtgctgcgggtgtgagggtgcgcacagcctcctggaggggaggggcctgagtggggcagtggagatagggctggccacagggccgtgccttccctggcccccagaggggtgagttgggtggacccgcagggacaaagcaggggtcagagctgtgtttggttcctgagtgggccttgtccaggatggagagagcctcttttcctaaactccctgccaccagggaggcagctggcacggatgtcccctagggactgtgagtgacaagccagactaggcagagagtggggggggggggggggctcagtgtccgtgggggctcagagctgtgtcctgacccaagcctgcaccacagaggggaagaccccaagagaaacctggaggcaggtagagagcgccagggggccaccaggctcccttggtgcccctaactctgggcccccagcctggtctgagcctttgggtacaggtcactcaaggcaggtgttctgcaccatccatcttcatatcgtctctctcactcgcacccttgcatcactgtgcttctgagagttgggcgcttaccttaatctactgtccctgacctggcaaacagtggaaaggtggcatgatgtggccctgcagctgctacacctctaggcgccatcattcatgccatggctctgtgacagcaccccctagagttgtgcagtgtgcaacatgggtgactgtccatggcagctcacagcatgtggctcagcccattggccatgcagggggctcctttcctaggagcagcagggctgggcttcctctccacctgtaggggcagcagtgggcatcttaggtaaatgcaggactctgcagcccctagaggaccctgagtggtggctgaaggatggatgtgcccatggccttcccagagctcaggtgcctcagctctgctttcagaggagcagggcagccgaggggtgcctggcagagaggcctgccggctggacgtggggaccctggagcttggcctgaggggctgtggtgggagccgtgcctgagcagggctgtcccgtggcacacactcgccctggctcttctgcccatcacttatccccatgaggcaggaaagacagagtgagtgcggctgccctgggggctcggcactggggggatggtgacaggactcggggctcagggccgggctgcctggaacaagcagaccctgaggggccccctgcagcaggatccatggacccatctactgggccagcaggggccaggaaaggagaagagggagaccggtggggctggaggcaccagtgcgtctgtgcaagaggaggaagccctgtgagagggcagcagcctccggactgccctgcacaccgtgctgagaggcctggcgtccacctgcagcccaaggcagctccaaaagaaggtcctggtgcttctccaggaggcgaggctggccctgatgtttggtccctcctcatcggccagcctcatggtcagccttggctggtggctcccatggcaaggcagaccctggcctggacctgaaggctctgcctttgtgcagagccccagcctgacggtaccagttttcctttgttcccctttgtccagccctccttggatgcctttgctgtgggaatcccaggctgaagctggaggaaaggcaggaggacttcttgtccccagcctctcaccacgtgcctgtgcagcctgacgtcctgagacctcaactggtgatggggaggacagactggtgtctctctggggccatcgtcctgggctccccagaactgggagcccctgcggatcagcaggccccaggctcagcgtcctgagctggctcctgctcccaggggtggcctggcactggccctgcggtcattggacacccactggcctacgacaagccgcgcctgttcctaggagcctgtgtttgcccccaacagagccagggtgtgcctagcagggcgttcctgggcctgttgacgtgggcactgggcactctgccatggtaggcagcacttggcctgactgccaggtcatccctcgacgcctgcccccccgcccaggcggggctgtgtacaagggataggcttcccttctctcagtttccctacctgtcctcagagacctcacccctgactgcccccaaaaggcagcagatgcagtcgtgggcatgaaggtactccatgaccccagcggagaggaattaccacatatgtgccgaggcaaggacagagtaagagtgggggtctccaggagggtgctgtgacccccaaacccagaatctgttcgagtcacgccagggcctgccccgtcccgatggactgaacctgtgcgcccagggctgactcagcgtctgctgagcagcacaggctgagagccctgcccatccgcccaggctgcagaagtaccctgaccctccacccccaccctgccttggcgcctggcagcattagctcccacaaggcctccaggtgccctcagaccaccctccctcctgccaccaggcttcctgcatctctccacctcccaggatccccacccagttcacccagcaccgccccgcccagagccactgtcctgaactggtttcctataaggactgggcccagccaggcagggccaggcagaagtcagggcgtggaggtggggactcctgccctgcgaaggggcttcagggctctgagtgctgcctaatctgccagtgtgtgaagttacgtcccaggagggtgagccccctgcctggcatctctggatctgccccccctctgtccccagggttgccctgccacgaggcgccggggctgtttccgtgtaactcttgtccagatgcatcgtgaggagctagtgcagagggagggggccgccatcacggagggtcctgcttgggcaggcggggaaaggctatgtgagacaccccactgccaggcttgtgagggtgggaggggagctgagacccctctgccgggcagagagcagtggggtgtggctgggagaatcccccatgcgtagacaagttgagggcttttctgccgggaggtgaggcaggaaggtggggctggatctgggctctggggtcctggggacagagtgggccccaaaagggaagtagtgaaggagagaccagaccagtctgtggggcagggtatccgtgtgtggccccccgcaaccccaccgggaccctgcttaccctccaggtggagctcaaggagagagggcaacaggaagggtcccccatgccatccagtggctggccagaagtggggctggagacctggccttctctcctggggcagagaccttctggggctccctccaggctctgtcacactgggcctacaggggtctcttatggtggcataaagaccaaaaggtgctgtagggatatcccttgccgttggtgggggcctggcttcaggggcaatgagccatcatgggccatcagagatgctgcctcttcctcagctgtgaagcggggcctcctgcctgcacgtaggggagccctatcagccgtgccttgggactggagtgtccctgtatccatcatgccaccagcccacctgccctgcaggagcagagggtgggggcagcaggggacacccactggacctgtgccctgctgagcagagccaagcaaaaggcaggagggctttggttcttgccccacctggagagggtccctagcttatcctctagcttccactggcacaagaggcccttggggaagcgaaggcagtggcatccagggcgtggcacagtttgcttgtatcatgtggctgtctcatggcaggagggggattggagcctgcacatgctagtcccaggccctctccccaccatcagcaggaatccccccagagaggggagcctgtggctgggtgtttcccagaacagggctggctcagaatggctttttctttttcattcttagacgggaggtgcctgcccaaagggaagggtttctgctaaagtgggtgagggcaggtttggccgtgggggtgctgaattcatgttctgtgggagggttaggcctcctcattcctgcatgagaggagcgagctccagagcggggcccgcagctgcagagacctgcaccaagccacctggaggtgttggcaccagcctgggccagaccctccccgacccaggcccctgaccaaactgctgccctccttccaaggtgcaggatgcccacatcccagtcccgcacagacgcatcagagctggccaccaaaccagacaccccaaaatccaacagcagtgccctgcagggacagacgaagccccatgtgggtcagtccatgtccggggggtcctcagtacccaagtgccttcagctcagccgggtttctgttccaggggggcaacaacgccggccacacggtggtggtggatgggaaagagtacgacttccacctgctgcccagcggcatcatcaacaccaaggccgtgtccttcattggtgagtgccctgccccgacctgtgtgtgagcaggaaagggggtgtcagccagcccaggagccccacgcatgggggcacggggcaccagagcctggtgatgactgctctagcagtaggctggaccccagcctccacctgccccaccaggcactggtgcacagaaacctgcatagcccgggcctgggctgggaacgcagctgagaggacacagggctgatgggaggaggggcagagtcacatccaccgcgcaggagcgggagtgcctgatccctgatccctgatccctgatccctcacatgcacatacttcctgtgtgggcatggagaccacacgcccatgtgcccgtgactccatgtgcatacctgtgagtgagtatgtgcttgcgacaggcctggcttctcgctgcgtggcgaccaggctgtgtggacaaggccgtgccctccccggccctgccgagccatgtggccgtcctcttgcctgggctgctgtggccacgtggcaggcctggttccagccccttcccagtccgtgctgcagagggacctccttccacatcgcctgccccctcctgggtccggacacagctcctcccctgcagccacctgtgaccactcagtgctccaagaggcgagccacctctgtccccagggttccgtggctctttccctccttctctcggtcagaagcctgctctgtgcaccctggcctcagctcttagcccaaaacccccttgctcagagaagcttttcctgatcccagtggccaagccagccaggccccttcttgtactttcccttccagctgtttccagacttcagcaaggccatccttgtgatgtatctgaccccttcccagcccgtcaggaagtgggggtcaggcgcctcaggtgtgtgcccagcagatgcatgggcctggacccattcaatgtgagcagagggaggaagatagcgcggaggtggctgccgcaggggccatgtgtggtcaggggctgagctggagtgactcacccaagaccatcccctggggtgcagacccagtccctggccctcccagcagtggggccaggacagtgtgggggcggtccctagttcacagcagggaggccctaagcagtgaggtggcctgcccgccatgtcgcaggagcccctagccctggcagactgggcagtagcgctggctggccgctccgggttgtgctgcaggaagcccttctccagccgccagcctcgtcctgcccagccctgggccccacatggcaggaaacaaggccaaagaggcaccgcttagcaagcggcaggacgtgccagggctcacacagacaccctgagcttgcaacactccgggcctctgccgcgtgtttatttcaggatgccgtggcatttgggtgaccttttgtgctcaccatggcttgcgtcgtctccgggtcactctcgtctggactgaagtcccgtctccctcagctgagcctgtgccatggccagcctcagcgggaactggcaaagggaaaggggttccttggggaggcagcaggggtttctgaaggcttcatcttcaagcaaggggtttagagctcaggagtgtatttgtgtttttttgttttttgtttattttgagacagggtctggctgtgtcactcaggctggaatgcaatggcacagtcctggctcactgcagcctcaacctactgggcccaggggatccccctgcctctgtctcccaagtagccaggactacaggcttatgccaccgcacctagctgatatatatatatatatatatatatatatatatgcatttttttttttttagaaatggagtcttgctgtgttacccaggctggcctccaactcctggcctcaggcaatcctcctgcctcagcatcacaaaatgttgggattataggcatgagccaccatgccccaccagagcggtgcatttgtgacaatcgatgaacctacactgacaggtcatgatcacccagagtacatagtcacctctgggttcacacttggtgctgtacattctaccagtctggacaaacgtatgctgtgtatctgccactatagtatcgtacagaattttttactgtcctaaaacccccgagctccacccatttcattcatctctcccccctcaaccctcggcagccactcaccttatgctgtctcctcagttttgccttttccagaatctcagagttggaattgtacagtatgtcgccttttcggattggcttctttcactcagtaacatgcatttaactttcctctatgtcttttcatggcttgaaagctcatttcttttcagtgttgaataatactccactgtctggatggaccacagttgatttctccttttgtttactgatgggcctcttgactgctgccgagtttcggcgattatgaatagagctgcacatctacgcgcaggtttctgcagggacatcaatttccagctccttaaataccgaggaatgtgttttgcatccatcaccaccatccacctccagaactttcttatcttcacacactgaaatgctgaaatatcaaataactccccagtctccctctcccagcccctggcgcctcccattctactttctatctctatgaatttcacttttccagggacttcatataagcggaatcatcctgtttgtgtccgtttgtaactgccttatttcactcagcataatgtcttcgaggcctgtgtcagaatttccttccttttttaaggctgaatactcttccatcgtatgggtagaccgtgttctgcttacccattcatctgtcaatggacagctcttggctactctgaataatgctgctatgaacataggtgtgcccatttcatgctgggttgttttttgttgttgtttgtttgcttgtttgttttttgagacggagtctcgctctgtcacccagagtgcagtggcaggatctcagctcactgcaacctccgcctcccaggttcaagcgattctcctgcctcagcctcccgagtagctgagattacaggcatgcgccaccatgccaagataattttttgtatttttactagagatggggtttcaccatgtgggccaggctggtttcgaactcctgacctcaagtgatcctcctgcctcagcctcccaaagtgctaggattacaggcatgagccaccgcacccacccatttcatgctgttcttaatgtatgttttccagtgtctgggacacaactctgtctctcatgcctctgtctctcatgcaggcaacggggtggtcatccacttgccaggcttgtttgaggaagcagagaagaatgaaaagaaaggtaggtccaagctcctgcagacttgccctgtcccagacgcggtgccctgagcggttgttggctggagccttcctgagggtttctcccacggaggggactggcaggggtgggttcccaacatagctggcccagctcatcacccgccggctctacccgcgcagaaagcgagtgagctgggcaacccagaggcctcagatgctggtggcctcagcatcacggggccaggtagcacctgggaagtccaggaaggagccagggacctggaccagacacccagtgggaagtggggactgctggcctaactatgcctgcagggaaggatgtggctcctgggggctctgcggagcatctggccaggcacgcagaggccagacccaccagctgggggtgtgggcaagtcagacctagtgtgggcagggacggacggcagcctgagtgggtctgggaggacgctgagctgcagcctcaggctcaagggcgggacgggtgtgaaaagagcaagaatgtgattctggggacatgggcaccagggggtacccagactgaggccctgagggggcaggtcaccttcagagtggcagcagctagggaggaaagccgggcactcacaccagctctggcttcccagcctggagtgggcgaagcctgcaggcacgagagtgggcatcctggcggcggggtggagtgagggtccgggagtctcagctggggaggagacaacgaggggcgggtctgccgcttgctgcgcaacagaggtggccctgtcagcctcctccctgcatgccttacctggatgggagccgggcgagctagcccagctctggcccctcacgtgtgagctgcagcgcacctgtgaacactgacccacctgtgtgccgtgtccccgcaggcctgaaggactgggagaagaggctcatcatctctgacagagcccaccttggtacgtttcccactggagtacagggaacagcccctcctgcccccaccattgccagccggccctgctcctacatggccaccgagatcagggaagtccccaaggccttcttgctccacatggctccattagcttgtacattacccttttcaaagagcttcaagttgggagctgggtcaggggtcactagcccatttgcaggtggggagactgagccccagacactcatggtcacaccccagtttgtcctctttgaaatctcaaccacccccttcccaggagactcaggccagcaggaggtgaggtccatgtatacacatctgtcctctgcttctctcctgtctcctgctgccctcacctggcccgcccgacagtgtttgattttcaccaggctgtcgacggacttcaggaagtgcagcgccaggcacaagaggggaagaagtaagtctgccgggacactctcaccctcggggagtcttctgggcccgtaagccggtagactgtggggcgtgtctggtcctgggcacaacgaggagggtacctcaacccactcaaagcccctggagaatggcaccgtcaaaattccacagcgcatcacccaacccccggacgagccagcccgtctctctctggggttgcacactgtccttgccggctgccactgccacgcggctccccccaggagtgcataagccctaccgtcacctgtcacacccaccacctttcctgactccacacggccccagggaagacacgaggaacactaaagcagtttagtagaacctcagatgtgccaaggacacaggagtgaagcagatgagtgtcctgcctcagagaggtgatggtcacacacttacccactcacactctcacacaggcacacactcatgctcttacatacacaccacacgcccacgcatgctcgcacagttatgcacatgtgcacacgccacacaagcccacacacccacgcaaatgcacaaaagtacacacagccacacatgcacacactccacatgcacacatccacccacaggcacacaccataccagtacatccatgctagtgcgtacacccacacacgcacacactcacagctcagccagacacaggcagcaatggtgggcactggagtcatgagccggcgggggtcatggcctcagtgggatgcctgagctcctcagggctcctgggttctcatgggtacccactccccatctttcagtataggcaccaccaagaagggaatcggaccaacctactcttccaaagctgcccggacaggcctccgcatctgcgacctcctgtcagattttgatgagttttcctccaggtacctgagccgtctgcagtccccggggaggatggggagaagttgccggaagggactgtggctagtggggagggccctgaggaccagcatggaccatgacagggggtgatgatgactgtcccttgtgcagattcaagaacctggcccaccagcaccagtcgatgttccccaccctggaaatagacattgaaggccaactcaaaaggctcaaggtgaagtcggggccgcagtgtgggggctgcggaagtgctcctccagggaggctggatgtcctacctggtgctcgttgaacacccttggggcacacctgatactaggcattgttatgggctggccaaccttcttgggacgcaggcctcccctgccccaggccacaggctcactctgctgcttggcccttccttgcagggctttgctgagcggatcagacccatggtccgagatggtgtttactttatgtatgaggcactccacggcccccccaagaagatcctggtggagggtgccaacgccgccctcctcgacattgacttcggtatgtccgggagggtgtgcgtgccaacgacctttcgtgcctgccagggaagacccagctgcggagagccgtgggaaccgatgggggagggaggggcagacccgctttccaaggccacagtgccatccatgcccgcggaaatgatcctcgtgtccttagtgttcctattgtcagcaagggaggggagaggagaaagggctgggctagagatgaaagaacagggtgacaaggtcaggggtggggccagggagcctggcaaggtgggtcagagccagcccttccgatggtctgtacagccatatcccgtcctcacccccacgggcgcaccagcttaccctcacccccgaggcggcctggtcacctcaggccatgctgtgggcaactttctccctcctctcaccccagactcttttgtgagccacatggcccagcacacagcacccattcggccactccaccaggacaggccaggctggcgaccccacggagggggccccccacggtttgaactgcccactgccctttactgagaaggcctcttgggccgggtggaataatctacagggggtgacaggtagccccctaaacctgctctgtcttgcagggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgtgagtccccagcccctcgggaccccgtgggaggacagggaggccaggcaggggtgccgggggtggggtgagcagtgccagggtggaggctctgcggaccttgccagtgccatctccccatctcccaccagggcgcttcctgccgtgcaggccaggggagagcttagtaagaggcgctggggtgggcctgttcccacggccacagcacgtgagctcacacggggtgcgcacatgcccacacgtacacgtgacctcgttcccctcggagtgtgtgaggcccacaggcaagtgcggacgccttgcagttcctcaggacaccctcattcggggtagctggtggactcaccttggctcagagaggacactaagcatcttccctcagccttgtccccaggttggggggtcctctgtcacaaccaagctagaattggggctgaaagccaacccccacaaccctgcccagctctccagccccaggaaggtttctggaagctgctgtggccccagaatcctcaggagaccccagccttcctctttcaccctcaacctgtgacccttggtagggcaaggacatggcccttgtgcctgagcaggaggaagggcaggtgctgggaaagccaacacggggaggggcggacgccatccagagaggcttgagagggtgcagggatacatatcgggagatacacacacccctgacccccaaagccaagctgcagggccaggcccgcctcccccagctgcccatggcaggaggggaagacagcaaggctgcccgtgccttccccagctcacaaagcctagtggtctggtgtgttcaggaagagcgctcgccggctcgggtggcattgtgggccaggccttgcccattgtgagcctcagctgctggacaggcttaccaggggtgtggggatgtccgggagctggatgtaaggactgtcggtggaggcggggcaccctcagggattctgagagctgtgtgcagggaggagggggagcagcagggccaggctgcacaaggctcccacgacagctcacatgacgtcctccctgttctcatgtaggagattggaggcctgctgcagacccgcggccacgagtggggagtgaccacaggcaggaagaggcgctgcggctggctcgacctgatgattctaagatatgctcacatggtcaacggattcactgcgtaagcaacccatgctgccatccccactgggaccgtccctgactcccgacacctgcagaggcaagcagcacttgacgcaggggctgagggccaccaagtctccttggacaaggtttccactgatctcgacccttccacaaagcacggcccagaggttagcggtatggaggcctgtgcagggtgtgttggagccagccgtaggagcacaaactcccaccccagggctgatgccgtgaaggatgagggcatcccggcacttgtgagaggttaaaatgcttcatgtggagagcggaagtacccaggacgaaaggatgcactgtcatcctgctagaaggacggcagcatgggtgccggcctgttgaggcatccgctctgcaggcccctctgctttccacagactgacccaggctgcccagctgttcgggctgtctcccagggatctgaaagaggctttgtgtgaggggtgggctcacagcttcctttccagctcagtcagacaggccaaggctgtgagtcgcacatctttcaccagggttgagagcatcagccaaaattcctggagaattaaccagacccctgctaggtgggtatagagctaatccggcaacgggaagcagaggaaccgagtagctgagggtgtggcgtctgggatccgtgaccctcactttccttgtgcgcgatgcagggttcacggcgcagcctcatcacgtgctagggccagcatggaggacaggcagggtcagcagtgctcagcagacccatccatagcctgctgcatctggcgccccttcaggctttgcccacggagggaggaaaaacagagcccatggcacagggcctggtgccgaagatggaccaggaagggaggctgccatcattggcatcagtgggtgggtgggcagggaccaggaaggtgactaggacaagggtgccatgctcacgggctggacacagggcagtgctgggccctaaacacggctgtgctgtggggaaagtgcacgtgtggggacgggaggggagaagtggagcctgggggagcaggggtcccggggggcactcgaggtacaggggacttggaaaggcagagatgaggtgcagggcgtgagcagaagcccccaccctctggcatgtttgtcaatggcgcttttttgggatcacttaatctctcttttccactcagtgtaaatcagcagtccctaacttttttggcaccagggaccagtttggcgggagatgattttcccacagacagggcaggtggcaggggtgtggcggcggatggtttcgggatgaaactgtcccacctctgatcttcaggcattcgattctcacaaggagcatgtggcctagatccctcgcatgcacagttcacaatagggttcaggctcctgtgagaattgaatgacaggaggtggagctcaggccgtaatgctagcttgcccgccactcatctgctctgcagcccaattccaaacaggccaccaaccagtactggtccacagcccagggactggggacccctgctgtaagtaacagaagcgagaggtcaaaagcaagcggaagaaaccccagcactgctgaccacttcttgggtttgcccggccccttggctttccacaggctggccctgacgaagctggacatcctggacgtactgggtgaggttaaagtcggtgtctcatacaagctgaacgggaaaaggattccctatttcccaggtatgtgaagtggggcaaccgttctgcctgttgggccgtttcatggtattggaatagataggacctgtgacttctcagagaggggtgagttcccacgttcacaggacacagggcaagcagcttgtctccagtgaccagcctccatcatggcttttgcctctcacgggtttctccccacagcgttccccaggaggcctggctgggcaggggtggctgtaggccccttccagtgttttgggaatggctcagggggacagactactcgcctgggaccctgggggaccttcagctgccttgaggaaaaggcccacctgcagggagccacgggaggcacacaggagttagtggatgcggtcggctctggaagatgtaaagctctatgcggacgtacaggatgactatttcatctgagaaaatacgctttgtggcgagatttttaagacctaaccgggatccctgctccatgcaccccttcttctggaaagcatgaaggaggtgccattttcctgggtttcacaggtttcagtttcgtgtgcgtctggatgtgccccctcgacctcggtccagggtcatgttctgaccctgttccccacaatggcttcctcctcagcagccctgggcgagctgctcctggctggtctccactcagcagatctttgtaggccacacagggccacttggctacaggagccatgtgtgtccttgcaggcggtgtccctgaccctcctgacccttgacctttgagaggctgcacttgtgaggactgcaagctctcctcatggtggtccagggtcccagggggacacgcaaacactgcctggctccaaggctcaaacacacttgcagcgagaacccgtattccagcatcttccatctgtaagggtggttgtcttctaccaggagccacagagtcctgcacagggccgggatccctgccctctgggagttgatgctcttggggtgggaggacacagatgcttcaggatcccttagtgcttcaggattctagagtctcagaatttccaagccaaggcttggagtgcctcagctgatgtcacagtggaggttctagcagagtgggtagcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcaggtgggtgccctgcatccccagccaccctccctgcaccctggatgccccaaggggcccacatcccagcgcagggcttggtgagcaataagaaaaccaagtgtggtcaccaagcgaatatattgcatggcaggaggggaggacgactcggagctggggcagtgtggctccgggctagggtgtgggtgtgaccttgccgggagcccctgcctctccgcatccagaacaacagatgggacacatcccagccatatgagtgtgtcatgtttaccctcataacccagaggtgtttgcacctacagagaaagggtctgcagggagagtcactaagtaactaacgttgccatttccaaggaagaagggaggagactcctgttttccgctgcgggaggatcagtcccccaacatgcactaccttcataacttaaaaattagaactgcctccatttggagagaaaatagccccttttaccatttgaactacacagaaagatacgacactaaagacaactttttctgaactttctgcctccagtgtgtatcataacagtcttttctgctctctcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 1316 - DNA, 26395 bp, Homo sapiens
tttgaaaagcaacttttattgaagaatttggagggaaggttccatattatattataatagtaaaaatactaaagttgaatgttgtaaaaaaacgccgtggtgcagcggcagcggcagcgtctggccaggaggcgtggaggggcccagggatggccacccccacagggagtcagggagggcctggggcgacagcggaaaggttaagcgtcgaaaaggtcaagtgctaccgtggagagatcatctgagggggaggctcccggtgggacagtcaccaagaactgtgacacagaaggggaagggggagggctttcctgtcacaaagattaaaaacccccaaaatgcatttgaacaacataatacacaataacaaatttaaaccttgctcctctgtcccactgggtaaaccctggcccatcccccatccctggtcccatcccaggggcccagcctccgatgacgtcctcagagacacggccttagtgctggggggctgctgtgtgcctgccacccccaggagagggtgctggccagcataccatagtgaggttgcatctggtgccaccaggttgaactgaggcccagggccccagagagatgacagatagctggtgacagacagcccagggcggctggctgacagagtgaggggacacatgggcaggacctgcccggccccccaatgccacattgcgcatagctgcagaagtccttaacatttccctacgtgaatcggattgttctgagggctgaggccacacccggagaacaaactggatgaaataaattaaaacccgcaggatagttttcttccctaccccgctgcgggggagggtgctgcccacagcacaaaaacgtctttccatctgggctcgagaggacagcgtggcttctctcaaatgcacccgagaaataaaaaccattaaatacagatcatggcacgaggccgcctctccatccctccaagctatcgtccagcgcagtccaccgccgcctcaggccgtgccgctggccgagtaggagaactgggggaagtggggcctgcgctcgctgtccacacactccatgctgtcatctgtgggtgtagacagctcagaccccggtgccccacctccctgccacctccacccacccacagctccagtaggaagccaacctcttaaagcacggccagcacgctgccatactgccaggaaactgagacagggccccacagattgacacagggacctgggccctcagagcactgcctcccaccctgatcattggcactctccaaaaggaacctttttaaatatttagattttaaaacatctgaagccaaaaaagctgaacactgcaggcctctctgagtgtggagagaaaagggagtgggcgggggcaggcagtggcccctcaccttggtcaggtggtgtgatggtgatcatctgggccgtgaactcctcatcaaaatacctggtgtcagtctccgacgtgacctggggcttgaagggtgggctgagctgcagaggtgggcagacgggacagtcatgagcttcgctccccactcccagcacaccctcaagtgtgctcaagaccttcaaagcacctggatctccaaggggtctccaggcaggactgatgtcagagagcagcaagccaccagccccccacagaggcagctctgggagggagggacatgaggggtgcaggagcacggagacaaccctcaacagctgagacgcaaagctgccctcacagcagccccagcaggcgacaggaggtagtgcagcccagctctgagagaccctccctgctaccaggaggtgataactttatttttcctttttctttcttgttttcttatttttcttattggtcttcttgtaaattgggaaagagggagactgtggaacaaggtgcacaggatgagcccaccctgcctccatggctcagggactacaggaccacagcctgctggcatctggctgcagacaggactctcaatgacccaggatgaagggtgactataaggtgatgtgcacacgtgaggagctgccagagagcccctcaggtcccacagtcaaggaccccctcaagcactgccccaccccagagtctgggctgggcaccagcattgtccattgtcaattagcaaggtctctggtcaaggctgggcagaggttgagcactgcccaggccccccatacccttggagggcagggcaggagggtggcaggcctcaaggcaggaacggggaccaggaccagggcaccctgtgttaatgggagaacaggtgcccagctgggtcccagggctgcccagcccgaccagctgcacacagcctaggacaggcattcaggggaggggcaggctgggaacggggcagaagcacacctggtgacagggcacccagcatctcagagtgcaggcttccgaacccagctggcagaccccatcagctggggtgatggccagggctcctagggtccctgaaagatgagcacccaggatggcgactcatgcagaaagagctgcctccctccagggcggactcccccatgtgccagaaaagtaggtgctgtccctgtccctgcacagccagaaatagggctgggctctccttgcggcagaagggattgaggtcaaacaggaggaactcgtggaggccaaggggcagcacccctggtccaccaccagccagccttcactgcacagcgtcagggaagggaaccccaaggctggcactcagagtgtgacacacctccgaggggaggaggaaactcagagtgtgacacacctccgaggggaggaggaaatgaggaccaggccagtttcctggtggaacccggcagtgccagagcctctgagcaccaggcgctgaggttggtgcagcaaggccctccttgtaccaggactgcagcaggctcctgaggtgagggcgagtgtgtgggaaatctggcgagcgtgccacgtgcatgcgtgagtgtggatatgtggggagcatgcgtgcgcgtgaatatgcggggagcagccgcaccttcttctcgtacacgtgctgccacacgataccggcaaagaagcgatgctgcatgatctccttggcgtcctcggagcccccgccaagcctgcaggcaggaaacaaggccacagtgtcggtaccgccacctgcccaggccctgggttcaggccccttcctcctgtgatgtagggcccgccagacaggacgttccggggccagggaggggagccggtggtgcagcgtccctgagcagctgtgggtagcaaagcaccacagagctcacggcagggcaggggcttcctgagtgggtgggtgcaggctgcagggttggggacagaggcccaactgaccccggcctgcccgccactctgcttgggcctgaggctttggagatcagccctggccaaggacatcaagctttggctatcagtgtagtctgggaggtgccaggaccgcctggcgcaggggcaggtgcagcctggggatgaggggatggaggtgtagcctgtagctgggatgggcggccctcacctctgcttggggtccttcttgagcagccctgaaagcaaggacttggcctcgggaccaagcgtgcgcgggaagcggatctcctccatgaggatgagctcaaaaagcttctcatggtcctggttgtagaagggcaggcgaccgcacatcatctcgtacatgaccacgcccagcccccaccagtccactgcacggccgtagtcattgtcctccagcacctgcacgggtggcagatgggcaggactcggcatcaaggggtgtccgggacactgccgggggaggtgtgacgtgcttggggcacagagaggacacagcattgcgtgtgctcaggacgtggggacgcagcaacgcgtatgcacgcaggtggggcgcacacctcgggggccaggtactcaggtgtgccgcaaaaggtcttcatggtggcaccgtccttgatcccctccttgcacagcccgaagtctgtgatcttaatgtgcccgtccttgtccagcatgaggttctccagctaggggaaaggtggcctcaggtcagtgccgccaggcccccagggccctgcccccctgcctgcccgccagcgcaccttgaggtcccggtacaccacgttcttctccgagtgcaggtagtccagggctgacacaatctcagcgccatagaagcgggcccggtcctcggagaacacacgctcccgggacaggtggaagaacagctgcgggaggcgcaacctgaggcacagccgtggctcgggcctctgcccccatggcctgcagggctggggtttctcagaccgggtctcggcattgcacagggaagggaccagccaccagagggcacgggggcctggaaagtctcagaagccctaactcagcaggaacaagtcaccccacagcaggcagctgcctgggcaggcatcacaccacccacccagcagggagcaccgtctggtgccatggagagtagccgaggctccgggaaggaccggccccaccatgggcggcccacaggccgcgaagtccatcccccgcagccccagcccctacctcgcccccgttggcgtactccatgacaaagcagaggcggtcgtgggtctggaaagagtacttcagggcctgcaaggaaggggagctggaactgcggccccacaggcaggacggcagccccgcaccacgctgcccgacaccacgctgcttgataccacgtcgcctgataccacaccgcccgtagccccacaccacactgcccgacaccacgctgcctgataccacaccgcccgataccacactgccccacaccacacaccccatcacactgccccacaccatacacccccacatcacactgcccccatgccacgctgccccacaccacactgccccacaccacactgcctcatgccacgccaccatcaggctgggccccggcagcccctgaggtgccaaggagtgtttgaaaggtgagcaaggtggcctgggctcaggtcctccagggtgagttgggacctcagcaggggacagtgctcccagcaccagggccttcgcaaagggaggacacaccctcccaggcgagacccaccctcccgccttccaccacaggcgactgtgcttttaaagcaaaggccccatctgcaggagaatcgtccccaaacacagtgacctggaactaaccaagtggctggaccctggcccccttcacagtaaatacctcctgggccaagtccccagaacaggttctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccctcacgtgcccaagaagacaggacatcgtcccctagagacagccccaggagtcgctacctggccccagcccttcagccccatctgggctcccactcactgtgaggaaggggtgcctggagttctgcaggacgcggttctcggtgagtgtgtgggccacctcgtcctgtaaagcagggctgggtgagctgccaccccgcaccctcatctccaccctgccccaccgccccggccccaccttggccacgatgacttccttcttgaggatcttcatggcgtagtagcggcctgtggccttctccttcaccaggatcaccttgccgaaagtgcccttgcccagcagcttcaggtactcaaactcgttcatggtctatgggcaggcaccagggtcagcaagcggcgctgccaacagtgcccagctggtcggcatgcgtggggtggcatgaggggccccagagtcggaggcagagccaggagaggcgtccacttcacacctggtggcctactgggctcagcggggagtccaggcttacagggaacacatggctgcggccccagctcagagcatggggttcagggaagggtggggtaacattgcccaagcctggcagggctcagcaaccccagttttcctctgacatggggaagaggacccacctgggaagcagctgcgccctacatggaaaaccggcctaggtggagatgccgtggagtgctgagtgtctcctgggccgagctgggaccccatgacccacccagccctccacagtccaaggcagccccaggcacaggcagaagtggggacaggcctcaccacgcggtgcttgggcttggccagggacacctccatctcttcagcccctgagttgtcactgggtgagcccgaccggaagtccatctcctcctcctcctgcttcttgaggccgtcagccacagtctggatggcggttgtccactcctccctgcaggaggtcaggtgaggctgcaggcctgtaccagatcaggagctccaccccacgtctttcacccacccgccagcctcacaagcgtggttccacagctgtcggggttcccagagacagccctgaggaggccaccacttgacctggtctggccacatacactcagggtcacgaagccctcttggacgtgggggacacccaggcttagccccccagcaggactctgtccccacaaccggactccaacccccagcaggactccgccccccagcaggactccgccccccccaagcaggactccgcctcccaagcaggactccgccccccaaggaggactggccctctccaccgggtttttctttttttgagacggagtcttgctctatcgccctggctggagtgcagtggtaaaatctcggctcctgcagcctctgcctctcgggttcaagcgattcttgtgcctcagcctcccaagtagccgggattacaggtgtgcaccaccacacccagctaagttttatatttttagtagagacgggggtttcaccatgttggcaggctagtctcaaactcctggtctcaagtgatctgcgcacctcggcctcccaaagtgccgagattatagacgtgagccactgcacccggtccctagccagtttttatctccagcctcagtttccccacccaaaccccacaggcaggactgggccagtttccaaactgggctctgaggagggcctgggagcactggggagtgaggatggctacaggcagaggtgccagcaccccgccatccccgtgtccctcctaagcgctggggctgcccaagtgcctggcctggccgccacagcccacgtaccgctcctcaggagtctccacatggaaggtgcgttcgatgacagtggtccactgcaggcagcggatgatgaaggtgttgggccggggccgctccgtcttcatcagctggcactctgcgggcaggcagagcctctgtctgcgtgcatccccctgcccctcccagggccctcaccacagcccccgctgcaccagccagctccccttgcataccacccaccaggtcctgggaagccccatctcttcctctctccaagcctcagtttctcgcctcacagagtggggctaggacccctgttccagctcagacactctactccaggctgaggcagccacacagggcatctggcccggcgtcaggtcaaacccccaccatcgtccactcctacagtccttccttcagtctctgagccccgccgtgcgccaggcctcagaggatgaggggtatggagatcccacagaggggctggcatgaggggggcaccccagaaacctgcttgtcccacctagtgtagaaatgtcctgcttttttcccaacctcaccctgagtacctgggaaatacagccacctggagcacacccacacctggggcacacccacacctggggcacaggcacacctggggcacagccacacctggggcacaggcacacctggggcacagccacacctggggcacacatacatctggggcacacacacactggaggcaaagccacacctggggcacacgcacacctgaggcacacacctggggcacacgcacacctgggacacagccacactggaatacacagacatctagaacacatctagacacctagccacatctggggcacacgaacacctggggcacacgcacacctggggcacagccacacctggggcacaagcacacctggggaacacatacctggggcacagccacacctacagcacgtacaccctgagggctgtgggaacgtgcggggccctgagaggtgtgagtgagtggagtgtgtagccgctggggctccgtggcaggctctggcccagcctgtgcaaagcaggaggaggctgaggggccagtggggggcctctgacattccagcatcgaggccctggcaaccacaagggggcctggccaggcagcaaggaagctgtcttccaggcctgggggccaggagggggctcgggaccagcctggtggggagggtggcctgtgtcaacacaggccagagaagtggaaaccggtgtgaagccccggcacacccacctcccactcgctcctggatggtccgatctgccccagtatgcaatccccagggccagagtctcgagcccactgccccggaaccgttccccggagaaaagccccggacagaggcccagcacagcccctggcccctgcccagctctgctccttggccaggcgctccaggccactcacctatggcctaatctgaaggccccagccttgccagctgctcaggcaacacctccagctggtacccacccgtgtgcctctccagagagctccccacctcgttccttcccaatgcctcggcctggcgagcacacccacagcacccacccccagcaaggccctgtcccaggtgccaccaggcacgctgctggcacccagcctctccctgatccctgaagcccccagccccaaccgaggagacactggggagggtgtgggacaagtcacagtgagtctcctgcatggttacgaggctgtcaggagacaggggtgtctgccttcctggtctcccctcacccctggggtgccctactctatcaggctgccctgctactgctggcttgaggctggaagagccagggaaggagacctcggcttacaggaaccaggtcctggtaaaccccaccccaaccccagcccctcagcctggggctttgcagggcaaggcctctgcccctcccaactagaagcttcagggcacggtttgctggccacagaccacctagcagccagggtgccagactgaccccacctccccttatacgtgcaggcaccaagggtgggagtccttccctgcccagcctggggacggattccctgcatttaacctcctcccagaccctggaccagaacctgggggtccagcaagttcaagggagtcggaggaccgcaggcctcaaagaaaggagggcagagctacttggaggggaggggccgatgcagcacatggggatggaacctaaggccagcccctggtgggcacctcgctctgcaccacagacctgcctgagacagatcccagaggcctgcagttacccagccctgccacatacagatggcccacaactgggccctaattagccactcagtcacacctgcatgcccaacccgtgtctctggctgccacaggcagagctgggctccaggacagggacacagaaaatggggaccatgctgggaggcccacgtgtccccagcctcccacctagcagggcgcctgggtctccatgccagggttcccgtctgacatgggtagggtcgcacctgcccccgctacaggtaaggaataaagccacagcagggcggagcagggagcgtcacatgtctctcatctctgtgggatgctccggccaaggtcccccgctggcctttctgcacctgcccctccatgggcaaggaggcagcctcacagaggggaagcaaaggctctgccatggggtctggaggctgagagcctgtgcagggagaggcacgagctcttcctcgagtgatggaggcttcagagctggagaccccaatggactcttgccccctcacccaaggggtttcccaaggagaggccctgatgggctctatctaacccccttggaggaggggcccccggggcagctgtccaccctgagactgggctctgctgccacttgtccggaccctccagcttccagagcatgggcaccagggaactgctccagggtcagccagccttgggactcggcccagagacccccgcccagccagcctcggcctcaggactctgcccagaaacccctgcccagccggcctcggcctcgggactcagcccagagaccccggcccagccagcctcggcctcgggactcggaccagagacccccgcccagccagcctcaggactcagctcggagacccctgcccagccagcctcggcctcgggacttggaccagagacccctgcccagccagcctcggccttaggactcagcctggagactcccacccagccagcctcagctttgggactcagcccggagacccctgcccagccagcctcgggactcggcccagagacccccacccagccagtgcttgttgcttgccagcccaggacttggaggctccaggggacccccatcgtggggcctggtgggcaaagagggctccagccaaccccccaaatctgaatcccgagaggccaaggggatacttacgcgccacagagaagttgttgaggggagcctcacgttggtccacatcctgcggccgctccttgtagccaatgaaggtgccatcattcttgaggaggaagtagcgtggccgccaggtcttgatgtactcccctacagacgtgcgggtggtgagagccacgcacactctacccgtcagaccctcgccaggcagccaggcaggaactgggtgtgccaggacagatgtgcctgggatgcctgagtcccagggggcaggcgcggtacgggagctgtttcttagggccagcgacagaaacggccctgggtcaacgggaaggcagactcgccccaccacagcgcccctctcagaagagccaccccgagctgtgtctgaaaacgggctgggccagctggacgcaggggatggagtaccatggacaggaggctgggaagaggtctgggccagtctgcacagccttcctggaggaggcagccctaaaccagccagtccccagcaggcaccagcagcagctcgggccccagctatggccacaggggctgcggggctgacagcattccccaatcaaccagggtcggccaggtggcgacagcaggtgacagtggcttgtgtgggctgcccagcatggccgccccccccgccccgccgccacccaccaggaggatggagcatggcgtccacagttagaggtcagcaccactcagactgagggccgggctcgcgggacaggactgcccactgccgtgggatcgcactccctgtctaggggcctggagcaccgtcttggggactgccgatgaagccagacacggaggtggcccagccagctgggcaggggccccagggcacagagggtgccaagtccccaggctgagacccacactcaggccctgccgccgtcggccctgccgcgtcccacccgtgggtcattcaggtacacgggaacattctccctcaagttttgcagcatcagccgtacgcaggcgttcacacttcagaatcagagcagctgtcctcggtgatagcccagcaagtaccatttttcatactgacactcggaaaaaaatgttccacttacattttgccaagcaaggagtttgaacaacagggaacttactaattaggcaactgcttcatctgaggggtcactgggcaggggttagggagggggccagggtaaggggttggggtccctgagctctggggcctgggttttcatgccacactgagccccagacagggacacctggagggatgtgggggacaagcaattgtcccatcaccagaccacccaccacccagtcctgctgggtcttcgtggtgagcccagacgcgtccagccctccctggtgcacagggaagtcccagcagggcagcagccccaggggagctcagaggacatgggtcatgggcatcccagcaggcattctactttccagggagccacgggggagttctttaatagaggtgagccaccaaggctcgacacatggccaccccccggccaggtgacctctccctcctaccccggccccagctgcccaatgcccttcccaccagcaccacggggcgtggtctccacaagaccagccctctctctgcccaagccagggctgctggggggatgctggtggagggtggggacaccccacccagcagggcctgagtgtgggaagaggctgttgtcaggtctggggtggaccaggaaggggacagccacagcccactcatagctgcctgacacctctggaggacggccaacacccagttgcagggaggatgatccagggcccagaatctgcccctgtgcccaagagcactcatcaggagaccccacccactccgcaagccctccatgcccctgccagtgggctgccgagcaggcgtggtcctgccacccttgggtgccggctcctgtccctgacctgggatctcgcacacccccgagtgtgcacatacacgcacatacgtgccacgcagctccaccccgcctcccacgtcccctcccccagccacagggcccctgcaggtgcagcgggcaggcaggggcgctcagtgagagcagagcaggctcagggggctgcatgcagcccaccccacccgtcccccatcctgggccaccccgctgctcacgcccacccgcctgcatgccagtctggagctgtcggcccctgatggagtgcctcccatcctgccagctgccactccccgggacgctaactgagcgggaagactgatgagcgcccaggcccggcacccctgaaacccatcttatccaccaactgctgccagcccccaccgtgcccagcatggccccgtgctgcccccgagcacgcagctcccgtgcccaaccccagccttgcccctgaccctgctgccacaagcccagccccaggttctgtgagctgcatctggggggttctgggagctggatctgggggtgcgggaggggcaggcccaggggcggcgcttaccaggcgtggggggtgggagaggacaggtgcccagccccgagcattcctggggagtcctgggatgggcagaggcccaaatgggccctgggctttcagtgccttcccctcgcctggccccacagacccagggaacagacggcgatcagggcctaccccaggagacgggtgtgagtgaaggggcctcacgtggcctttgtcttcggcatcccagcccagcacacagacccctccaggggaggagcaggatccccagggacccggggtaaggggtccagagacacacagttctctttcttcatctctcgcctagagggtcagctagaggatcacttgggggggtgccagctgcagccagggccgtggcgcgcatcttaacgagttcagcccagacaggatgctgggtgggcggccagccccgacagcagatgcggcagggccccactactccctgatccaggactggggtgacacaggacggggcaggtggaggagacagccacccggggcccagcatcactgtcctcatggccacaggacgcctgcaggcctgcacctgcctactccgggtccctcaggagggtgggagcacagacacatcagccagggctgccctcccagacccctcacacaaagagaccaacccacatggagtcttctccttcactatcctgagggtccccaggggaactggaacctgtcatccaggacttaacttgagttccccaccctgttgtggtcctcagatgccccccactcgaggcaggagtacagtccacttgaagagtggcctctcaatccctgacaccccaggaaaagtgccctgcattgctgggggaactggaaccaggcagtagggacctcgtcctccacaccgaccatgggaagcacccgccacagaggggccttccatctccccaccatcagccagctggcatccccccaccccaccccagtcacccccccaacaccaccccacccacctgcctgcacagctgagggcaccaaacacagagtgggcacagacccccaggttgccacgccaggccctcactccagacgggtacaggcaggcaacaaatggggaggccagggcacgccccaccccacacacagccagagtcatctcctgccagcagccactcccaagggcaatggagaccgcccagcattcaggcccagggggcctcttcagtccctaactctcacacccccatgctgggctcaagaacccccaagtccccacccgctgcacatgtttcagacccgggacctggagcaggcagggtcccagtgcaaccccggcctgggcctcagggtctggcagggaagacggctaggtgccccttcagaaatgtcagcaagtccggatgggggaccccacaccactgccagaagacctgagtggggggccgagtggaggacggcactggggactggtcccaccttcctgccccatggctggtcccctgggcaagggggaagcagcagctccggtcccaccctcctgccccatggccggttccctcggcagcggggaagcagcagttccagtctcaccctcctgctggccccctgggcagtgggaggcagcagctccggtcccacccttcagggttctctcaaggccagccctgggccaggtgggagccaccctgacccttaaccctgtgacactgcacctatccaagaccaggtcctgtgaagccacaagggcaggggctcctgtgcctgatgaaacccgtaaccctccccaccagccagcacatccatggcccagggctccaggcatgggaggtggctgccctcggtggggggtaggcagttggccagactcctgtccctgcccggggggacagcggagaccaggctccctcgactcctcctgcacctcctgggccccacacaaccccagccctggtccctctggcatcccgatgtcccgggtggccctccggcaggagtgaccttccatccccaaccccgctcatccccaggaaggggctggagcacccccagggaaagagggttccttcccagaagtcctcctggaccaaataccggggttctgagaggaagctgctcctgcctggcctcccccaacccaccccaccaccaccacggggaccacatggacagtcacaggcagcccaccctctccacgcctcacacacgtgtcccaggccacactgtgggtcaggccccccaaagcggcacccacttagacatgggggccaggacccacgcgccatgggcaggactgggtgggcccctgagggccagctggtggccctccacgtcccgggactgaccacctcctgagccaccaggtgtgtcagcccccctaggccaccacgtcctcagctccctgaacattctctcaaagtccccagttctcaggaaactgctggataaacacttcgcagagacggtggtggcagcggctggcagggtgccaggcggcaccgagctgcttctccacagcaaagtgagcccagcaggccctgggagcgggcgccagctgacagcggccaccgtggtccccactgccgacacatccatcgccccgacagctgccgggggcccatttaccttctccagcacattgagcagacggctccgctgacggcagcccatgaggggcccgcaacccaccctccccgcctgccaggagaccgcacagctcaccgcgaagggcccggcctgccaggcctctgcccgggcccgggagtacacacccctttaccagcagccctcgaaccctgtaaacaaccaggctggggtgggggcaggggaggggccacacaacggaggccagctgaccccacttggctggagcccccaggtctgtgggtgaaatacatccactgctcctcccggcacaagcccttctgagggggcacaagtggccagtctgcacaaggagaggtgtctgttcccgccaggcagaggactggcgctccacctgcctgggcctcgcccagcccaggacccattctgctctcccagaaagcccaccaggcaggcagggcgggcagggctcatcatgcccatcagctccctgggaaaacggagacttaggggaggtgaccctcagaggcagatcatgaccagagagaccccaggtcctgccgccaaggcaggggttgtaacttgacacaaactgcaaattcttcacctccttccgctccaccatggagcaggcctcagcccgacacacacaccccgggaggaacatggtgcgggcaggcggcaccaccatgaccccgtccacctcgctgaggcacagccggaggcgctggggcctctcttcctgccactccagggaagcacctgggtctcagctttccattctcctggggctctactgggtggggtactgggcctccctggtgctgcccctgacagaccacctgggcctggatgtcctcccccacaggcactgcccgtcacccacccctcgggccggcaaaggcaccccacctgccacacacccatccatcgcagagcccagcacatcccaagaccctgtccctgtccctgtcccccacctcatttttggtctgccccaaacaagccccacccatgtcatggcccaccctgcctactcaggacccctgcagatgaggctgcagcccctccctggcgcctcctactctgcccccgcccactctccccataacttgcagcaggctttgccaagtgccctccacccagtgggttcccagggccctcaccctcgctccctgcgtgggaggaagctgggcatggggacagcacacagtgcctgctgcgagggagggctggccacagtgtcccacgtgtagacactgccctcgggaaaggaagtgggcacgggcacaggctccttccggggctcggccgggggcacgcagccatgcccacagcccctccctcctcccgtctctcttgggcagggcccctggcggttgaagggctccagtgctggcctctcaatccctgacaccccaggaaaagtgccctgcattgctgggggaactggaaccaggcagtagggacctcgtcctccacaccgaccatgggaagcacccgccacagaggggccttccatctccccaccatcttgtttctgccccaacttggagccacgcctggggcaggagggcccccagagcacggccagctgtggagggtgctccttctgatcccccggcctgctgggacattgtggccctgacccccgtggcctcaccccacacctcaccaagcttgtgcagctcagcgtctccgcgccctacacctggctgctgtgcccctggccccagtctgtggggaggccagccagaccctggccagccgaagggcctctctgcattctccaggcccagggagcagccacctccccgccaggcctgcccagggggtgtctccacccctgagctggacaaccagctgagggcctgggcaggtgggcccgccaggttacagggtatgggtggggtctgcagtcaccgggcccgcctggggggtgtgtgagcccaaacacagcgccccaaggatcccaccccaaagcccgcaacattggcagcagagtcacccatgaactcccaaccccctcaattccaacgtttctgaaatccaaacctatcattccttaaggttcaaggaaaacacacctaaaggcggcatggcagggaagggaactcccgttggagatgaggaagtaaggggcctagggttcgcctaacagccccatcctggcctggagccccagggccctctgccaacctgcccggggccccagcgctgggctgggggaaccttctcctgaggccatgggactaggcacaatggtccaagcagacagaagcagcaggcagctgcccacccagggtggcctggggagcaggcccagagccacagccacagccaccagtctcagctatgggagggcccgagggcagggtgctggccccaagccgggccgggtgtgcccaggcagaggggacgccagcgggggccgcgccagttccctccgctcagcctcgtgcaggacttctaggaacccggcctgatgcaacccggccaggcttctcctgagagtggaaggtgtacgggggtctaggccccagcacaggaatcattccacccacattctgtccactctcctgggcctcagtttcccttcccggagtccagccccccacagggcatccctgcccagagagggccagtgaccaagaaacacacaggaagaagagctgtccactcaggagccaccaggcgtgggggctaaggtccagggctggggccagcagtgacccctcacccccactcaaggccacctcggcttcctcttttgttgtttttgaagtgagaactcaacaagctcccaaaacaggaacctccctgatgctggcggcctccaccacagccatgccatgacctccaccagcctgtgcctcctgcccctctcccgggtaggcccagggctgttgggacccccactctctgcccagccctcccaccaggagccagcacacttgcctccccatctctgtccctggcctgcccacgggggccgttccagaccctcaacgctcccccaggggaggcagagcttggcactaaccagcccagggcccgcgggtctcacactgaagccacctagacgcagcctggggttgaccctcacctgacagcctgggaaaaactgaggcccaggaggcacaggcagccctggcctggagcccaaaggttcccacaggctgaggggagagtctgcgggctccctccctcagggtcctgctgggcccctcatcctggcggggtaatgagcagcctccatctgcacacaaacaattagccctgcggggccctccgcagcagctgctctctggagtgggctcagagtcccccacagacctcttctcaagggtgtttactcagcaaagccaaggcctcctccaggatgaaggggagtggcctgtaccctctgaggtcccccacctcacgcagggaccccaggaccagctggatggctgagcagcagctggggatgcagtgaggttctatgtcgctcaccaaagcgaagtaacacactggggtaggaaccactctctccctgcctcagtgcccccccgcagggacagccagtgccaggacttcaaggcggggagagggggtgggaaggaggcccagcctaggcacctgcttggggtcagagaccagcctccatactccccaccgggacgcctggggctaactcagcaggagtggtgagggggctgccctgaggcctggactggggggtctatgccaggcatgggcccggggtagggcatggcaaggactcagatgtccggagactggaccctccgtgagccgcatggacacacggtcccgtgtcacccgggcccggccaggcacccagatccgtggcttggacacgctgcccacacactcaggagcgtctgccgcgtaacccacgcgccccaggcagcttccctcgacccccgcccactcggccttggcctgctgggtcacagcctgccgaaggcagccaggcctgcagctcttccccggcccctctcggacagcgaccagcctgagggagtccaggtggtgcccctgcggccggcacccactcctggcctaggcccagccctttctcgagagcccagagcacctcatcctgggtcccagcatcccggccacccgcctcggccctctcctgacccacttggtccagccatgtggacggggggacgctcaggaagacagccgcgagtggacaaaaacaggctccaggccggggctgcaccagggcagctctccacggggctaggctgcagccaggctggtgcacggccccaggagtactggggcaagcgggcaaggtgagcaagctgtttggggaaagtacctcaaaagagccacacagcctctggccaaagcctggcacggagctatcaaaggaaggaaaactgcaggctggaggccgagttcagccagacctgcgccctggcccaggattgattttttaaaattgtcagccttcaaaaatcaggagacttcacacaacagaacaaatctttgaaaatgcaaacgtctgagcaacactgagcccaccagaccaccaatggccagagctgagctgggctgcttatccagtgagacagccgaaacaggaggggacatctggccccctgtccctataggccccaccagcctcctcactagctcctgcccttaacagcctaagctcaccctccaggaaccatctccctgttagatgtgcagacccagaggcctcgcctgggtccagccacaggtccacacaggcctgcagccggaactcctgtgtccccatgcccggtcccttctgtccctgaagctcctctgactcagagcacacacatcagaacaacagaaagcagcctgggccacttcccagagatgacgctcacctcccaaggagcaggagaaggagcctgcagacactgccaccccacccctcacacacagggcatacccgtcccctctcatctcaatgaccacatcacccctgaaggcaccatcacgccacgtgtggccagcccaagtagccgtggtgggactgtcacctggggattcagctgagaaccaaagtgccccaggccacggtcgtggggagtcccggcaaaggggacaggtgcgggccagcctctgagacaagcaccctgacctgcaggagcaaggctgggggggagtggaacagggcgtctgcaaggggctgcggccgggcctggaggacagtcactgcgtccctccctccctccccacccccagccaggcctgagcactgtgaagcacgggtggggtcagcccagcacagccctgctagggacaggaaggcagctagtacctctaaccagtgttgcgggtggggctggccctgccaggagggtggcacagcacatctgcaagacacacaggggaccccagggacgggagtggcgaaatgcggcaggccccggaggacaggctttcctccgcaaggagcggccggccatgcgggtggacgccacctgctctcggcaacaagaggggctatgcctgccaagggcatatgtcatatccacgccacctcccatcctcagcgcccactacactggggatggaggaggaagagccgggggtagaggtacaggaccctctctcctggcctgaggctaggggccagatgacagagcccagaggctgctgaggctggccggaccccaactcagggccgcccacaagccattctccactccaccaggtctctctcccaccaccgctccctggtgtagatggggaaactgaggcccaaggagctcaatgaccttgctcttggaaagggtcatggcgatagagtggctaaccagggttcaaactcagctctctggacgccccactgggcctgatgtcctgtccctgccaggcccctcctgaaggcacgacatcagcagcagcctgaaaatcacctggcctcgggggagcactcctgcctaggcccagctggctgatgggtgccccagtaactggggcctgggcccctgggcagtcaaggccctggcatctcctgggtcagcccgagatccaacagtctatcaacaaacacacatttgccaaggataaagaagcagcggccccaggcagcagactatgtgacacagagaggaacagggccagggtcggggcagggggtccctgacaccaaagagggctgtgaggtgaggagaggacctccaggcacaggtggcaggactcctggggaacaagcaggggacagcacacggggaggggatggagaaggcaggatgcggcaggaggccttggggggaagcagagccagaagctccccaaggaccacaggcgtctgcagcctccttgtcttcatctcgaggccccgcgtgccatcactggtagctgcccactcaaacactccaaacacacagccagccacacccctgattcccccagcatctcatctcggtcactccttcaccccacccccaggctcctgtggctccttaggcctgctcttctgtgagctcctatacatcccacaatgccccatcttgtgacacctacttttgccacacctccctgtctgctccagctgtgtttggggtctccccactaccagatgtgaaacccatctgctagagggtgtacgtaaagccggggggctgctggcatgagatcactagaacttaggagggaacaagtctggaaaaagaagtcaggagagggcggaccgattccgcctggggcagaagagagtgacttggccagaggacctggacctgaacaggaagcccaccctagcaggacagaggagcaaaacagccacccagactccaccgcaccccgctgagcaacggagggtgggtgaggcagaagggcctgcacagggttggaaggggtggggctatgtccccagctcccatcccacccagctgctggccaggcccctcgggcagcacctcctccataggctgcaaggccaaatgagtgaggagggggacacaggggctgggggacttggctcagccagctctgcagctccaaggcaaacatgccctgtgcccaggcggtacggattccccccacccccaaagctcaggcctgaagcaggcaccaggccaagccaagcagccctgccctgccctcaggagcccttgggcagtgccctgggccgccagcgtgccagaccctggaacagcccagtgtcctcgctgccttccaggaaagccaggagagaggctggcagcagctcccccgcctgccagggcccacaccaggaagccactcagatggccggccctgcacagggcctcatcctcctggcctccccgaggccgtgccctccatgccatgggaagacatggggcccaggacactcaccctaggccagcccaggagccccaggggaggcagcccctcccacccagcagggcacaggcactcacagaccctggggctactacccccatctctccctccccaggcccagccctggcagcgggtactaacctcgtttgtgcagccaaccctccttcacaatagccacgtcgctcatggtgcccgaggctcccgcgacgctcacgcgctcctctcaggctggcgctccccgagcccagctggcctggccacagcctctgggagaagcaaaggaagctgaatgtgaggccacgcctggctaagggcagctcctcgccctgggtgagccagagacccactgcacgtgcctgggggctccacccgcacctgccttcccaggtgggctgccatccctctaagctctctgacccccatctgcccgcctgccttccctctccccaaaacactcagggctgccaagtgtcaaatccatgtaattgaacacagttccctggacctgggcctctccttattctaggcttagagcctccagcccctgccaccaccacccgcaacagccaggccctgagagctgctgccttgctcacctccccattcccacctcccccagccgttggacaaatcacccccatccccaaaaggccttcccagcctccctaacctgatgcaccagctgacaggctgcctcctccaggcagcccctttgacttctttgacccaggctggctcggccttccctaagcccctggtgacagatggccccgtttgctctccctgtccatggtgttcctacccatggatcctgggacagggcacagggctcctccctgctccccagactaggaaagcaaagaaattcaaacatgaggaagacaggaccaggatgcaggccactggcgcaaacgggagtccagagccctccagcgcaagcccaaaaacctcctgggagaaaccccaggcccctcctaaaccacagcgcccctgccggtctgaatctggttcattcatttggccaacatgtaccgggcgtctcaggttttgccaggcccagtgctgggcgctggagacaaagagaggttcagacaagtccgtcagtgaggagcacccagtccagggtggttacagacccataattacagcagtcgggaggcagcaagtaagtgggggagcactggacaggcccccgccctgcagcggcccaccagccaaccctcacctgagcacactttatccattgatcctgcatggcttcctcatttcccctctgatggatgaactcctaggcatccctcaaaacccagttcccacatcaccaactacaggcatccccagaaagagcacttcgcatgctcttcctgtgagcagtcctctgctacccttccagatgggccttcctgaggggaggagggtcctctctgggacctccaggccaggcagagacccctgacgacctctgtggaatggatcccaacatgggtctttccacagccagcttagacgctctccccccaggccacctttctggcctcccgaggcaagggctggacacccacaaagggttgctttgcactgattgtcttaagctacacttagaatggcaggaaggcccactgccttgtgtctaatgccaggacagggaagaccacaccttacccaaagagggaaatgccccaagtacttagcaggatggaaagcaggccagactcgaggaaggcaccgcaggactccgagggcagggctccgagccgcgcacgcctcaggcacagggggctctgacgacactgagtgggcgtggcctggaggcagagggctggactcaaagacctctggatgtccccccacccccacacgggcctgagcccctccaaggcctgctgctgacagagtcagacagctgtccagagccatgtgtaaaaatacatctgtgctcacacagggtggtgtacgtctgcacagaaacgtatacaccaggccagcacagggctgcctgtgggggcggagggaccccgacttcccacagcctccgtacctgccgcctgcctttaccataagcacatattcttgctactattattaagtcacaacttaaaaaaaaatactctgttttcgaaagggctcctccatctgcctccagaaccctggtgtatgagaagtctacacagctcccgggagaggcaaccggacccccaccaacggactccgtccgcccttcgctcggatgagggactcaaagcagtcaagaagtggccacctggagcaaggccgagagacccaggagtgaatgtggggcggcctctggctgcagagcaggggcccaagctcacccgctgaccaaggcagcactcagaggccgtcccgacaggaccaagctcgctagcgccccaggatactcaatctaaggggcaagccccagctgccctccaagccttggcctctgggatgggcgggcaggacctccagggcccacccaagacaggaagcagttccggggcccaggagggtcacagtcctttgtggctagcctgggtaccccgccaccacgtacaacttttcgtccgtgggaaacgaagtctccttccggggccctcccacaaacttgaaggccggccgcggcgagtctttctccaaccccggggcacctccgccggctgcctcgctggcccagcgcccggggagccccacggcccgcaggggcaccccgagccccagctccaggcccggcggcgtcccttctctcgggtcccggcctcgcccggcggagcggcctccccaaggtcatgagggaggctggggccggcagcctgcacccccggcgcccggcgtggggccgccctcccttggccgggcccgcgcgccccgcgccctccccgcccaggcccgctcggccacttcctgctcccgctcctccattctggcggcgccgcggctcgcgccccggcccgaccggccgcgaacaaagcggcccggcccgcggggaggaaatccaggcccgggcggccacggcgggcggggactcaccgggccgccgcgtccgggcgcgagcgcgggcctagccgggccgcggcctccggcgcccgccgctccgcatccccgcgggccggcgctgggcggggccgggctggaggccgcggcgggcgggggcgctgctcggggccgggcctcgcgtgccgccgccgctcggtgcccggtgcccagcgctcggtgctcggccgcctgctcccgtcttcgggccgcgctgcgtgcgctgggccagccgcctgccgcgctcggtcctgccg

SEQ ID NO: 1317 - DNA, 26395 bp, Homo sapiens; identical to SEQ ID NO: 1316

SEQ ID NO: 1318 - DNA, 30006 bp, Homo sapiens; identical to SEQ ID NO: 1310

SEQ ID NO: 1319 - DNA, 57 bp, Homo sapiens
tgacgaagaggcgagagctgcttcgggaagaaccacctgccctcaccccactcggtc

SEQ ID NO: 1320 - DNA, 15204 bp, Homo sapiens
ccgccccgcgcccgccaggagccaccgtccgagccttgcggagcgcggcagtgggcgccggctgcccgcagcccctgacccggccccggacggagcgccggccgcaccaccgccctctggccgttgcctcaccgggtaagtccttggcctcggggtccgcttggagcttcaggggaaactgagtccgggaggaggcaggggcgtgcttgggtccaggagcgaggttccgggctgcggcgtgtgtgcccaggtggcggcgggcggtccggcggcgcagggtacagttcccgggcggggaccccagggcgcccctggcccccccggctccgcgcgccccgctcgggactatggtcctccgcgccgaggcaccgcccgagcgcgcactggccgcagagtggtgggcccagggtcggccgggcctactcccagggcaggcgggatttccgcgcctcgcggctgccacatcctgaccatgaatcagccacagttgggaaaataaacttcaacttcgggtccgccgcccgggtggcaccccgaggtgcgcgccggcctgcggccccaccctgactgcttggcttccagctgcccacgcgcaggtgggcgcacagggagcccttcccaccccgcaaccgctggcaggcttaggggaatcagcctccatcacagctctctgttccttttgggtggggtaggatccaatccctgtacgcccccagacccacccgtcaaccctctaactggggagtcgccccaggagtgaccatgactaaggaggggaaggcggggtgaccagctgtgtccctgaccgtccccaatgccccctggggagcacaggcgtggggggtggtctgtctgtctgggccttctggggctcaagctccccacccagggctcccgcagctcagctgtgaccacagcattactgcccactccagctggacacaccaggaggcagagaggcagagaccctgcccaggcagggaaccaggaacccaggaaccgggccagaggtcaggcacacccagaaggcgctggacgtaggaaattcccttactgccagccctgcccctccgtctggcactggaatggagcaggatactcgccctcttccggcctcagtttccacatctgcactctgaagggtgggacagcagctcaggctgggacctgctccctgccgccctgcactgggaaggtggggtcccagagcagtgcctcagaccccgagggtgccacccagccaggggcttttggggtgtcggtgctcagcccccagtgcagcaaatagtagcattgggttccaggcctggggtctgagacctcacactgctcccacccctaccagggcagcagcaattttctgttctaaaagccaggttggtgcagtgggccctgcccaggccctgccctcccatccctggactgtcatgggccctgcagcccggcaaaggggatgtcgctagtggggacggaccaagtggccaggtgcgactgtagcctccacagccagggctcctgagttaaccttcaggtgagcgcccactttgtggaggagctgacggctgtcaagcgaatgacacacaccgcacatgtggggacgtggaagctcctacctgaaatagactctgcgccttccatcaaagtgcagttacttcctgggttggaaaagttatgcggttcatgcaggctgcgggaggggtgggtggtgactggaaagtgatgcggtgctgcctgtgggtgtggggcaggacgcagctggcccagctctggacggggacagtgaagtaagctcaagcccctggctttttgctggtgcctggaggtcaaatttccctgtagtcaggaatgagacctgactccctgctgccagcccctcccctacctccatcttgcaaacagcaggtgtctgataggtgtgtggttcatggcccagtggacacattacattggagaaggcacacccacctctgttttcaggatggtggacgggaaggccgggaggtggaggccacataggagccagtctctggagggtggtccccaggggccacagcagacccaggcctagtggacacctaaagtcaaagactaagttctaccaacggtgggaaggagagagggcaggggcacgggctccccgtcgctggaggggtgagcagggtccaaccacctggccccctgttagagaggcttccactcctgccagcctcaccctaggagggagagtcctgcctggtctgcctctgagcacccagacagcctgggtcctgagctggggtgaggtctgctcacacagctgccccccagcccagtgccggtataccctggcaaccaccaggccaggagagcagggcagaccggtggtgcctgtcctctcctgaggggccgtcctctctcacagccctttctaagctgtaattaaataaggaaccacaggggttgcttagggtcgcccctctgagggctcatgtcagtccccgagggccagcctcaggccgggtctgtccactcaccattcacgccagcctgggcagggtctgtgtgctgggtgagtgggtgaggaggaaaggaatgagccagcctgcggggtccctccgcacggtctcccaccctcatccctcccagtgcgacgtgggtcctgcaggagcgttcatttcacaggtgaggcgcgggacagtcggtgccattttacactcagtgccatccattctgccaggaggtgctgataaagcccctactgtgtgcatctgcccttgtgcccagagcctggagcccagccccgctcagcacggtgccaggcaggtgcagggcacttactgggggtcagggtgcaaatgggctggccccacagagtagctggaggccgaggccccccagcccttgttgctaccactggggtaggctcagggtgctggcactgccactctgggaataggacaggcctgtcctggtcaagtagccattaccgggcctccaaactcgggggttggtggggcaggaataggcccgccctccaggcaaccacctgtgtcactccagagcagcccatgcagacagacaactgcccaagggccagcctggaccccggagccctcccagccagtcggcctgggtcacagcctgggtggaatgaccagtgtggtcacagcccagatgggatgactagcgtgaaggccctgaggaccttgccacgccaatggccaagggcaagggccaaggctgctttcctctttcgcctgcagcttttcccagaggcagcagggagggagagagaggtaccaggagagtcctgagagaagggccagcctgggctgccccgagcctctgtgccctcagttcactcctgttctcaccccagaagggtgactggccgtggctggggcaccctccatctccctcagccccaacctctgtctgttggaaatggcatggagacccagaaggagcagatgggcaccactggaggcctggccaggctcctggccgccgatcaaggcctttgcagggtcagagggacatgggaagatgctgccaaggcccctggccctggtgccctgggcagggaccctgtgctcccgtgctgtgacagcgttataccaccccacctgcttcctgtgacctggacacagtctgagcaccccaaggtccaaagtgggagaggtggggtgggggagagggagtggggtggattggagggctgtcctactgttacagggctctgccccgggcccacctcacagtgaaggcagaggcccccaggcagcccttggtgggccagaactcaaccaggagccacactgggggcggagggcaggctgtctgcttcccattttgcagacgagggctagtgtcaaagcctagctttgaggctaacccagggcacagttgaggagggagggagagggaagcagtggccgctgagcacaccagccccgggtagtggcttttctgtatcatctccaagcccccattcagctgctgtgggcagaggccagccccagcccctcgctctgcccagcgagtggccagctgcccaacacgcatggagtcccagtgggcatggccagtggtgcaggggtttgttcgtgcctgagctgtcctggccctcgccgggtcgggggtggacgtggccagctgtgcgaggagggccagcatcccactggcctccatctccccatctgtacctgggtccttgcaggccctgggacatggcctcggtgtacagcctgcctgccccaccctctgtgcccccgggtccctgttcctgctccaggcacagctcagactgtcgcctgcacccagcctacgctgggaggaggacacagggtgggggtgagggagtagccacctgtccccacctgcctctgcttccaccttgtgcacagacatgagtggcctgagaacgggagccccttggggacacccagggcccctgcctatgcttccatgtgcagagggcccccccggctgccccttccctgggccaggccaggctgtggaggtgcaggcccaacagtgaggggctgcctgcaggagctggcagagccatgggccggacccaggaggggccacacgggcggtgctggcacagccaacccaggtcagagctacggggccctggagaacatcctggccattttacagatgagaaaactgagtccagaatgggcctggctgtcccaggcccctggcaccctcgtgtcccagcaagcattgccaagcggcatgttgcacccacgctgaggatcttgtttgcccagttgggcctgacgggctccctggcactggctgcctggagcagaggtcaagagacgctgagcaggggctgggaagattcatgcaacgtcctagctccgtcccagccgccaaacaggaggtgggctgagtgggaaggcgggcggtcagtgcgtggttatgcactggcattacaggtggcatctcgtcaatctgtcagtaagctgtgggggtggcattgacacactcatccgcatttgaggacaggaaccaggagatcctatgggtcacaggccggtcagcggaagagcccagtctcaccctgaatcagagccgtcccccaccctgggccctggtagcagcccctggccgtgctgggtgcgcaggctcagcctctcccccactctcaatctgtctttgttctccctgctcctgggaaggcagctgctagcggggatgtaggctgggggcagggaccatggagcctggctcgtgggcaggcagcgggcagccgtcttgtcttggcacaggcagggtgggggctggacaccctggggcccagctaggcacacagcaatcaggacctgaaccctgaagccggggcctggctccaatgagctgctgcccttccccctcccaggttgagagaggctttttctgaggacagaggagggacctggggcctcggaggaggcatctctgagtatgtctggtccggggggaggaaacccaggtgggaggattctggtgacgagctcctggccacctgccctcattgcccagcagaccccctgcagggtacgtctggggcctgcgataggccagccctgggctcatgccacctgcagggcctgatcaggccctgtgcccttcccagtccctaaccacagatctgtacacgtcactcccagccacagccatggtaggtgctggcaggccctcaggcccaggaagtacttccatgtagccgctcgtccccccatgcctctccctgggcccccagactccagcccagacccctgagaacgccagaggtgaccaggccctcagggagcaccccgttggccctgctgtttgtgcagtggagacactgtggcctgtagaaggcccattcggtgactggcgagccgcccacccacccaggccctgcacaccctcagtgcaggtggaagcgagagctgggcttcctggcgtggggcctccgcccttcctgtcctcccttgcctgggctgcgcttgccgactctcctcccagtgacccctcctcccagtgagccggggcatttcctgtttgctgcatccccctaccccccctacagagtcaccctcctccctgtggcttccacagggctctgttcctaacccaggaagatgtaccttccccaggcccattgtctgccccagatcctggggacacagagagcccagctgtagcctggctcccgggccagtggtgtcccctggcgttcagtgctggccagcccggaccccccagccacctccaccgacacttgccagagtgccatgaaggacccctggcccccagctctgctctctgggtgacccaagcaggggctaccaccgctctgagcccagcttccctctgtgagatgttgctgtcttttgatcattttgcttgctttcttcctcagtatgaaacgaccatattcatccgagatgcagcttcagttagtgattgggcaggtgtcccggtggtatcgcacccaccatgtgattgaaatccgtcaccatgcggcctgcttcccatctttgtcttctgatcatgatgctgctgagagcgcctttctgcccacctgctcccagggggcccttctgtcctgctgtgggtcctcacagtggcccgggggccctctttgcacaacaagcggagttcaagatcttggagggctttggaggcaggagccttgcactccatccagatcttggggactgcaggtggcatgagggctggagtgcttcttgggtgtgagacgggccaggtgacagtgaggacacagccagccctcaccaaggcccagtgcgccccatgcccctggacacgtggcagtgggtggacccccatcctcacctgccttgaggccccctgtgcacagaccctccctgggccttgccggcagttggtgagccaccaggtcagtagaggtccctcaaggggctgttggcctggtggggaaggtgacacatgctggaggctcaaaggagctgggagtctgagtgtgagggaggggaatgggggtcatggtagggcaggttcagctccaggtgcctccaccgccctgcagggcctgggctgcccagaaccccggggtgctgccaggaacgcgtgcagtcctggagatccatgggttgccaagcagtggaaaaattggggctctcggaggagctaaaaatacagtgtggcagcccctgcctcctagttccggaatcctctcctgccgttctgcccacccaccccgtggaagacaagctccctccctgcacccccaccaccaacgctggctcagggcccagaagcacccagccctgtgccagtgccagaagggcgacaccacagctgcctgcccactcccaggcagcagccccccacaggtgctcatgtgcccagccagtgcctgccctacccccgccactgcttcagggtccccagagccccttggtcccaggcacagtaggcagtacctgccaccccagggctgccaggctcagggcttggcctgttcctcgtggggagcctggacccaggcagacctctcccttccctaccagtggggacttcacaggggagggggctgtcccaggcagactcagaacatgtcacagcgggggcctccaggcccattggtgctggccgagggcataggagctcccacactgtgctgtggaaggccctcctcgcctggctcctgggaggcaagtgagggagccgaggcctgggggcttcagtggctggctcaggtccctcgcgtgctgggattcaagtctgggtaccctaaccctggcctgtgtgccgctcagaaccatgggcccatgcaggagcccccagctactctccacagctcggtgctgggcctgcctcaggagcccacactccctggctctggttttctgtctgcaccgcaggggctaggcacatggctgcaggtctagtgaaggccagcatggccctgtccccacccacaccacacactcagcttgactgttgactgctaggcggggcggtggcccggtggcttcccgagagtcagtgcagctgccctagcatgtaggcattcggatggaggtgctggcatcaccacaccaggctggccaggcccaggcccagagggggaccctgcctgccagagctagagtcaggggagaggcatggccccgtcctctggaagccccaggctattggttgacaaaagcaagtgctgaagaaccatggtgatgtcccactagcatgggtggggtgagcccctcagacctcagagtcttcatctgcaaaagaccctgccctgtgcagttccattggtgctggtggactgccggggggggtggatgggacgccccttcttggtgccctgacccttttgctgtccaaggcatggggtctggcctgagccatgggtactgggccctgcagagcctggatggtcctgccctgcctcagccagagctggtgccggctgtagaaaagattgcgaagaacgcaaattcctgtgcctgtggggaggtggccacgccctacagccggggctggggagctctgaggacacattcctgcgctggtggccccgccaacccactttccagatggagagcagaggggaagggtagcctgcccaggggcacacagctcagcaatgagactcccgcccccttcccttctcagttggcactggcaccttccagcgtattgttccccatagccccgtgcccctgagatcagtaaactgtggattccttctggaatccttgcagaagtggacaccaccccccagtgagaacaggcaaggctgtttttgcagagctcgctgtagcagggagtcggccaccgccacccgcgtttagcagagactcacaggcgggcgggggagtgggaagcctcatggttttctcatatggataattcactctatacatagaaagctttttatagacacagggaaggctcggggatgccctgagagaggctgctggctggaatttgggctcctatgagatgagacaaaaatcacagaagctgtcagttattacccaggtcccagccatttggggccagtggccagattgcgggtcagagtgctgcatatatggtctggccgtggtgtgtttgcaggttcagcctcatgctgaaaagcagttggaacattctccggtgtagagcctgacggggggcctgggtgagatcgggcagccttggcagcaccacagaaggaggagagcagctccggcctcagcctccggggcctcagccggagccctgtctatgccgggccgcagcccagcgagaccctgttacactcactgcccccagacagcacccggtgggacacggccagctggggcagctcagacacagagccaggcacccaggcacgggggtataggaacctgatgggcaggagggccagtttcctcccaccgtggctccaccccactgaccaagggggatcctcttgactggggtctttcaggggcttgcacagggcaaggagcgctgggcagtgccaagaggggcagtactcaggtcagggagcatcttctgtgtccagggacaccctggggcctggggcacggtggctctcggcggcactgcttgtctctaaaaggtcaggattttttgcatggagggacccccggggctcttggctggagaggacactctggatgccaggggccgggcctgggagagttcataactccgtccactcagcctgtgccaaggggacagggactccggccaatggaggcgggggaggaaaggagggtcagttctggggcctctttaggcagcaacagccaaggcgggtgggaatatatgcagaggcccggctgcctggctcttcatggtggtgggagcaaccctactgccaccaggaggggcgttggggacctgaggctgcctgggagggacccggctgtctctggcagctcagcggtcagcagcgatgagaagccaggggagcgtgaggagcagcccaggacagggcccagagtgggtgggcagaggtggccggaaggtcttgcgcatctgggtgagtggacggccactgggtgaccaagagggccgggcctgggagggtggcttaaaaccacagtgcaccgggggctccgggctctccgttctacagtgcccagaccaggaccccctgcagggaggaggggcatcccaaggacagcctctcaggatgctcctggcagcctggtgctggaggtgcagaagaagaaactgaggcccaggcaggatgagtgactgggccaaggtctgctggtgagggcccgggctggggacatgcagatcagaaccctggcttacacctgtcaggctgcctcctggaaggagcccactggccccctggggcagttggacaggtggagggctgaggggcggtgcggggagtaggggctggactgccggaaacaccaggcttggtcgtggaccaggctggggagtgggcctgagacctcaagggcaggtgctccaggacactctcccaaggcaggaggggaggaatagagcctcctggggaggcaggcgcttgggtgctcgaccccgctcagctcccgtgacctcaaatgcccttcagcctggggtcccctgacttaccgggttgggcagcacttgaagcaaagccatgtgggacctccagtcacagcccagccgtgcccaggtgtgggactgtgggcacagacccagcttctctaggacccagccgcctccagttccccacctgttgtgggaggtataaagtgcctgccttggaggtggtgggaagccgagggccagggtggagagtgctgggccggggtggaggctcagagcgtgtccctgccaggcccggccccctagctccctccccgaggctccacgctgctgttctcagacgctaaatataagatctaagccatacatggttgcaggagggcctgggatgcccctgaccttcgaggccagttcccagggtctgtggttggggacagcggctggggggatgtggtggcgtggagctgatgtcagaggtgcaacccgcctgtcctgctgttctgttttggggaaaggcacgtgttggggctcttctgggctgggcctgttacctacccgggtgttcccagggctggagtcagacctgttgcgactgaatcctggtaaaaccctgagtgccaagggtttccgtcttcctgttggtgtgggccccctacccacatgcagacgggcagactgaggcccaggggagacctgggagtcgcccctcctccccagccacgctgctgacgctgtgggcaccccaggcatgcctgaggtttggaatctccctgtccatattgtccactggggcgggggaagtgccctggggtgagataaggcagcctcagatgcgccgttttgtcgcatcattaccgtgggtaatgttccagccaggggagcctcccgctcccccgagtcctccccaagctcatccggtcccgtcactctgcaggggccgtgctggcctcgtgctgcaggtttctgagccggctcctcccctcccagccctgagcctcggggtcctcatgcgcgcagtagggcccttcctgcctgccgcctcggttgctgaaattcggtcagggatgggtacagggaagcctaagatatagtgggggacacagtgctacccctaaccctcagcatggcacgtgagcaggaattgcagcagagaaactgagaccgagggaagtggccccgcctgcgctggtggccaggaggacagcccccatcccctccccgctgacggctccctgccctctgcctgcagctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccagggtgagccgcagtgtgggagggccgcccaggcggacgctggggacctggtatgaggcttcaggcccaaaaggccccgggaggcctggggaaccaccaggaggaagcgcagccaggcaggcaaggagggcttcctggaggaggactggcttcctgggctcaggaaaaacatccacattcactccgagtctgaggcttccaggtcaccccagtccccgcactgctgcaccagcggtccccctgtgcccctctctgttgtgtggctctgccccacccttcctccccgtcctgtgctggctcccaccctctgggctctctgccctcgtccacacctcggcggcaggagtcactgagtcagagatgcgaatccacccgagtggctccctacatacacctgcctagctccaagcccttcagcctcagcccagacagagcccttgaggtctggcccacacctactgatggtgtcaccctccacctcccagcgccttccctagcgcctccctccccgccctgtcccctactccagcacccaggggactcgttcccggcaggcaggcaggcccttggtctctgcctctgctcgtgttttctgcctttgcgtcctccaaggtcctgcgccgctaagcctttaagccccagctcactttcctgtcctccaggaagtctccccaggctgtgcccaaagttagtcccggtcccttgagagaaacccttgctgtgccactccatggctgctgccaggtcctaccgatgcttggggacgagctagggtgggcagtgatgggcggggctgggcccatgggggcggcagttacctgtgcaggcaagcaagccagaggcgcctcgtttctgtcggacccaggggacagaggcaggtgtaggggccagccattctcagcccgtctccccagcctgggcctggcagggcccctctatggagtcttttgtgaattgttctcagcagggtcagatgagagacacccccagaactttcacagctccagatggggtgggaggcaggggttcataggaatgaggttgtgtctgccataaacacagtaagtgctgcattgggagaaaagctgggcccagagccagtgacaggatggggcagctgcctccaagcccttccctgcagggtctggccctgtggtccaggagcagggccaggacaccgaggagtggggcacctcgttgggtcccagcccactgctgtgggccacagacaagtgcccggcaccccctggcgtctgcctgccaggcccagagccccagccctgagcccagctgcacaggcatgggaaggggtgcattggccctgctgagcctgcccactccaccctggcagccctggacacatccaacgtgatggtgaagaagcaggtgtttgagctactggctgccctgtgcatctactctcccgagggccacgtgctgaccctggacgccctggaccactacaaggtgggcggcagggcctgggcctgggcacatggggctccctgcctgggtgtgccctgaccccgccctccccacagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcggtaagcacctgccctgggccgcatgcccgctcctgcccgcctcttggccagtgcatcccatgctgcatccacctggggaggtgggagcgccacaaaagctgcccccgacccagggccccagaggaaggcgccatctcgggcctgccaccacctgccccttcaatggacacaggcctcagaacgcctgggggtcaaccctggaccgttctcatttgtgagactggccaggcagtggagccggacagggggcctgagacctcgttctagccctgccagttctggcagtgagccctgagtaagcatcactgtgtgtccagcatgatgtctcccctccagagcctcaggtctctggtgtcccatgagtgcagcagggcagggtcaggtgctctgggtggcagaagtgaaatggggaaggcggggagtggcctccgaaccctctgaccctgtccgtcccttcccagggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaa

SEQ ID NO: 1321 - DNA, 31459 bp, Homo sapiens
cgtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcaggtaggacgcgccggcccagcgctggccgcggcccgggcctcccatcgcccgcacctgcacggctgtggggtctcacggggcgcggggtcccggccgaggccggacaaaggcgcgggggttgggggccgcccggcgcacctggtcaggcgggtccccgccgccgcggaggcggccctggtctgcgccaggccgggaggagccgccccgtttctacgcggcctgcggagggggcggcaagcctgggcacccgggtccccgccccggcaccggctcggccatggccgcccccggagagcgctgattcagaaggcgccgctccctcccccgccgggcccggccgcctccctcctggcctggtctctcctcccgcggtccctccctccgtcttcctcctcctcccctctctcctcatttcccttcgccgccgtctccccgctgtccctgcctctcccggcctgtgcgctccttccaccgccggcctgccccgcccggctcgctgcccttccctgccctgggcctagccacctttccccgcctcacctctgactgtggcccttccggccggggcggctgaggggacaagtttggggcgtttattattcttcctcctagcaacgatggccagcccagccccgaggcagccgaaggccgttttggagcgtcgcgggctcccaggccttttcagggtgggcggccggggcagtgggtggcctggctctggcacagcggcaccaccaggctctggggctcggcttcatttcgccttaaacagggaccgtggactcctcagggcgggccgcggcaggtgatggcagagggtgaggcctaggagggctggctgggggccggaggtgcaatggtggggtaggccctgcccgatagagcaccctgtggtctcccccagcagccctagggagggtggggctgtagaggcctcctggaggctttgctgtctggggctgcagggtcatcgaagtgccagccccttggcctccagtgcctgcctgtctggctggagctgggtgcgtggcttaggaagggcagggcccccagagtgagagggtcctggctgcctggagctgccttctcctggtgaggatttttctacatcttcccacctccctgcccaaggtgagggtttaccatggggcacgtggtcacttgggcattcatgctagctggagctgggtgttggttttccctgctgctcaccgaagggagctgagatctggtgaagagcctcaaagctgaagaccttgggcgtgggcactgggcaaagtagggacaaggagccactcactcctctgcctggcaccctcatgtggtgtggccctgccctcaggatgcactcagcccggcagcctccccttctcctctgctccactgggcctcagctgctgtcatccctgtcctgggttattgtcctcacttcttgactggcctcctgagtcacagccccatgtccactcaggagctctggggccggcctcacaggtatgtgacttggagacccccacagagcccttgcttggaccccgcatgtggcatcttgctcagctctccttctcagtttttgaataagggtaccgcgttttctttttgtgctgggccctgcagtgatggagccagtgctgggccctttagggacttcatccccttccaggactagccacaggactcccaggggtatgtgaggccctccatccctctgccctgtccctctgccctggtggcaccagctgttccctctgcctggaatgcagtcccacaagcgttcatgggctcacttccacccctgtcctgctgagcctggaggctgcctcccagtgagcccccatccccgccctgcctctgtgttccctgtatccctctttgcaccttctcataagccgtttctgttctctgtgcctgccccctgctgaagggagccccaggattctgagactctgtgtcttggtcacagctggcttagcccaggccgcctagcccatagcagcactcaggatgtgctgggcagtggggtggagtgcccaggacatgtgtgctggcatgctccgggcttgcagggtgcatgctggctgggtatagggctgcccagggttgggtcttggggtgacatcagccctggccattactcaggctgtccccgttacctcccaggctgccacggggctccctgcctgtctacaccagcccctcagaccaccccctctttgttgatgtcactgggactatgggcaccaaagcctcacttccctcttgggcactgaaggggctgcctgatgctgtccttgcaccatgcccaccaaaggacatttggcctcctctcggtggtggacatattgctgactcagggcccctgtctccagctctgtccctgctgcccctcaccccaggccctgcctggggctcagtctcagagtgtcctgctggggggagtgggtcctcttgttcagtgtatgtcttggggtgggtctggtgctgtggacctggcatcatggggaccctgatgggctatgctgggtcctacccatgagctgctcctgatgggtcacgtggatgtggggtcacttacaggcagtgcagccagtgtccccatgaacttcaacccctgacacctggaagatagaggagatgaggtgtgctggggcctggaggataagggagaaccaggcagcctttgccagggatggacgtgatgggaaaggccggtcacgagggcaaaggcctggcagtgggactcgggaccatacccagggagggcgggtggcctgatgaggctggagcccagcttctccggaagctgccagcttcccttagagggtcaggatctgggctgggccttggatgtgtccagggggctaagaaccaggccagggagccccactctaacaatcccctcttccccagggccagacgggcccagccagcaccaagatgagtgccacgtcctggttcctggtgagcagcagcggcgcccgccaccggctccctcgggagctcatcttcgtggggcgtgaggagtgtgagctcatgctacaggtttgcagggagcgcttggggccaggagggtagggggtagacagtctgtccctgtggaggccaggaaggtgcccaccccacttgctgcaggccaccctggcgaggaggccgccatgcagcccaggctgggcctcttaacttgggtcccggatgcaccgagggctctggggctcccgtgggtgcgtgcaggggtgtgtgtgtgctcacaggctcgggtccctgccccgtacgtatccctgtctctgacaggagggggcttaggcttttgtcaggttctcaaagttgttggggtccctagaagcgtgagttggcgtccttttgcagagagggagctgaggctgggctttggaaggtcctggaaagccggtctgtccatattcttgttgtctgggggccccgtctatgctgtgagtgctgcctgagcgggggtcccagtatcttggtcccagctgcaccctggtgaaggctagtgccttttggcggcctccaggcatgaggggttcttctcagggcatgagagcctgccgagcaccggcactgacaatcggaagtttctctggccctggtttgaggtctgagtttggctttgtggggcttgcgatctggctgtttgagaacaaagagcaggggtggtgagctaaccccataggcccatcctggcctgatgtccttcctctaccccgtgtgcctgtgaacgagttgggctccctgtcctggctcatcccccagcgtggcacgtgggcccctgacccaggtggatggcactgtccagtctagccgaggggcctgcaggtgcagggagctgccctgcccactcagacgttgcctcctggatgcaacgtgctactgccgcacatgcccgggccatgccaggctctgacgaggtgggcaggcctcaggctgtggtgaggggtcctggccatgtgcacattccctggggcagacagtgtttgtctgcctctacccagggcagccccacccgatattgctgcatgtgtcctgctgtggcgggaaggtttgtgtcccctgcaattcggaggttgaagcttcatttccagcgtggtagcttcaagagatggggcctttgggaggtgagcagggcgtgaggctttgcccttgggaatgggatcagggaccttaaaaagaggccagaggaagctggctcaccccttctgcccagtggggacgcagcattcaagataccatccttgaagcagagacagggccctctccagacaccaaattggccggcgcctagatctcgggcttccagcctccagaaccgtgagcaatacatttgtgccatttccacattactcaggaattttgttacagcagctgggatggactaagtccagacatcccagcttctccccaggcgtcctctgatcctcttgagtctggacccagcaggtctctcaccttgtggttggttgttccggctctgaagttctttaatctggaacattctctcccttttttctcttttctttatgcctttggtagcgggagagagtcggtggctgggggcaggagtcggcaaatgttttctacaagggcctggtaaagattttaggttttatggaccacaaagtatccactgcagcccaggcctgtggccgtggtgaggggcagccagggagcgagcgtgggcgaccgaggtgggcgcggcagcacctgcacttcatttatggatgttgaagtatcaatttcccataattttcatgtgtcatgaaatagccttttgatgattttcaatcatttaaaagtgtaaagatcattcttagttctcaagccatctaaagacaggcggcaggccataggccacgccccacataccccactgcctcatggggccgcagctgtatttggcgggttgctcccatggtctgcgtacaggggtggcatcagtgatggccgcgctgctctacctagggtggctaggagggcttcttggaggcggcggcactttggagcctctggaagaagccagagtcagcctgcaggcaggggactggtgtgggtgctcttcctgccccacccctgcaccaggcctgctctgcctgcttctccctggggtaggggaaaagtgctgggggcagggtgctcagggtgagtttggggtccgattccgagtttctgcacctgtcagtggagccctgagcaggtcgggagtgttgggggcttcccagctctcctcagtggccgcccctggcctgggtgggcctgcatttctacccctcgctgttgtgggtggtgtcaccattgtaagatgtatctccatggggaaactgaggctcagggaggccttgcaggtgtggcgagtgtgggaaggctgtctgcctcccggtgcccctgcagcggcctcctacctgcccaccgctgccccctgccggcctctgtcacccctcactccctgtgcacctgccctagaggcttctcacccccaccctacagccccatgtccagccccttggcccctctgttgcccccacctgaggatgtttgcacctgccgcccctccctgcagcaacttccttggcacctgcgccaggacccccgccctctcagctcatgctcaggggcctcagtggccctttccgaacgctgctgcttccccgaggccctatccacctctgctcagatgatccacatgctgcctggagcctgctctgtcctcggcttccagcctcctactggatatggctgctgcactggggcctctcagaggcatcccaagctcggtggctgaaccaaacctgtcaccctccgtcccttccacccggggtccccgccagggtccccttccctctgctcagtgccacccccacccccaccccacgcacagacaggaatgcaggcctccactggacccagcctctccccacacctgccctggctctccggacccggctcacaccgaccttcctgccctggaacctccacaccctgtcccagcgccccctccacagtccttgctttcggcgccacatctttccactgggcagggtgtcaagcagagaccctgccctcccttggcatccactgcagagaggggccagcaaggtgtccagggtccagtcctgtgtaaagaaggtggtactggggactgggcggtcagcagacacctgcctatgttgtgctgaggcccaaggagccgcagcagcaggagttggggccggtgaggagggggaggctgtgggaggacagagctgagctggggctacggggatgggacatggaggggagacaagcagagtgggcggcccgaggcctgggctttcactaggcaagaggggcggtagcttggaccacagcaggtagacgggtaggggagttgtgttccaggcagagctgccacccacgtgctgtcccacggaccacgctgtccagggccctgcctctgctccccacagtgtccttgtgcccagtgcaagcctggcacagagctggtgcccagcgaacaggcgttaaatgacgcaggaacgtggacccaggcaggacttcctgctgtggctgtcactcctgtggtggcccaggctgtggtccagggtgtgcgtgtgtgcgtcgtgtgtgtgcgtgtgtgtgccgtgtgtgtgcgtgtgtgccgcgtgtgtgtgcgtgtgtgtgctgtgtgtgtgccgtgggtgtgcgtgtgtgtaccatgggtgtgccgtgcgtgtgtgcgtgtgtgtgccatgtgtgtgcgtgtgggtgtgccgtgtgtgtgccgcgtgtgtgtgccatgggtgtgcgtgtgtgccgtgggtgtgcgtgggtgtgcgtgtgtgtgcgtgtgtgtgccgcgtgtgtgtgccatgggtgtgcatgtgtgccgtgggtgtgcgtgggtgtgccgtgggtgtgccgtgcgtgtgtgcgtgtgtgtgccatgtgtgtgcgtgtgggtgtgccgtgtgtgtgcgtgtgtgccgtgtgtgtgtgcgtgtgtaagtgtgcatgtgcatacatgtgcatgtctgtaggtgcacacatctgtgtgtgttgtgtgcatgtgtgtgctgcatgtctgtggggaggtgtcctccgtgagagcgtgtgacagctgggatttgcactcttgcgtgctgccccagagaccacagcctgggcaggccctgaccttctgtgccccgtgcatcgagccggtctgctgcgggtgcctgtggccgccaatggggaactcgggtgagctggcaggagggtgtgcccagagccctggctgctgctactgccactcagcacagctgggccaggctgttgccccagagggcgtcagacgtgaactttgggaacatctttattctgttttaaagtgagcacaaattattagacactttccccaaaatccatgtgtttggggcgtcttccggccatgccacacatctgtgtttgcctggctgtttctgcaccgagttccgtccacagcccgggtttctgttgttttaagtcttgagccctgggccgggggccacttctcattggtggctggaggctcggccaagtgaggggctgcttctggttggagaggggagtttctggaagggggttccccatgtgtctccagcgcttcctgcagtctggggaggggcttggcaggagcaggtctggtgagaaagccctggccgggggtggaggctcagtcctgggagtgggcggggcagctgggctcggggtgttaacagggtcctgcggggggactctgtgctgagtcaaaggagccggaagctggtgtgggccgggtggggtggggaaggtgggtgcaggcaggggagggggcttggactgaaggtgagacccaggcctgggcaaggatgcggtgtgcccagagctggcagagtcatctgcctgaagcctgactgtggcctgggtggggtaaggaaggtttggagaggctttggggcctgcgggaaagggggctgtggagagagaggctgaccgagggctgccgagaggaagaccagtgttgctggagcctgtggtggagaggggcttggtgggtgaaccctccagggaaggcctggggcagggctcagaggacctggaaggtgtgcagagttgtgtccagcaggagctctcgaggcccagcgggtctgaggctaggggagcagcagggaggcgtccaggctggaaacccctccagggtttccactcctcagcagagatgacatccaagtcacccgccctcagccacctcagccctttccagaggggacaggggcagtagctccttccttcatgcccctgctggaccccatcccctggggaggtctcatgctggcagggagggcccgagcccggccccaggcctcagtgcttcctttctctgagacagcagcaggtccccctggccccgtggagcccatgtgtcgggcgggctgaggtggggatgctgccctgtgcacaggacagggtgcgggagtaggtgagccccaaccccctgagggagatccaggcctcccagcttccaggctgcactctcaggcagggatcctggggcctggccctcagggctgcccacggggcagttagtggcctgaggtgtctccagcagccatcctagagttggggagggggtctcaggacgggcttcttggaggaggtgagtgctgggggtcgcctgtgtctggaggccttcagggacaggtaggaagtccaatggaggaggtgatgtctggcatcacccaccctggccaggatcctcccccaacccctccggcagagactgccactggggtggccaggagccacgtagctgtgggtgccagcttcggagaaggaatttgaacagggtggacctggaggtgggtggtggctatcaaggtcagacccactctcagagacctgtggctttggctggcaggggagctggcaccaggagccccaccaggatccgccttcccagggagggcatgtggggcaggaggagccgctcacctggtttctgggaaaccacgggctgtgtctgggcaggcagctcagggatggctgcacccaggaccctactctcccctttaaacctccctggcacccctgcccacttcctggggggacccagggtcctgacaggaggggtgggctcctcgccaccctccactgtagtccctgcccccggtcctccactgcagtcctcccctcagtcctccactgcagtcctccccctggtcctccactgcagtaccccccaacccccacccccggtcctcctctgcagcgcaaccaccgtggcttgagccaggcacccagggcttctgagtgcccactgctgggtggcagtggcactagcgtgaggctggctctcaggcctgctggccaccacgagccccacccagctgcagcttccctgccctggcacctctgcagaggcctcagtcaagctgggccatcagagcccttgcccccaactagcccctgctgtgtgatctcctctctgagttaggaaggaggccctgccctgagggtttctagcccttgcccaggggtgctggggaaggccccacactggtgtttcatgacggtgccctgtggtggggcagtgatggccagctgccagggtggcctgcacgtggcaggctaagagtgaccagcctgaggggcccaggctctcacctgggagactgagaagccgtgctggcactcaggagggacttccagctcctagtcgtgtgggttgcaggccgtcctgtcccagggctgggggacttccttcaggcccattgctgcctgtggaagctggcctggtgtcttgtgggtgtgctgcctggatggtccctaggtggtggcgagggtcacacgctgtctgggccaggactcggtgacttccctgggtcggctggttctgctggcctttcctggggctggatccccaggcctgtggctcctgaggtttgggggcaggagggatggagccaccacccagagccccaggcagcacagggtgctgtgtggagtggaggccgggtgggcagcagccgtgcttgcagcgctgtgtggagttgggggccgggtgggcagcagctgtgctcgcagtgctgtgtggagtggaggccgagtgggcagcagccgtgctcgcagcgcttaagcaagtagaaagtgactcgcctctgcctccgtctccccatgccccagtggggcagtgatgggggcttggctgtggccttatgattggacgaccgggcttgaccttgtgagggcactagggcacctgtcctccgggggggtggtcctgggtgggctagtggcccagaaagggtcggcagcacttggagtgggagcaccaaaggtgtggacactggctgagagttgtgtgtgttcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcatcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatggggtaagtgtgagaggccctggcctggccttttaacagctcgacccttcagccctggcccctccctctcagttctggctcctcccccagtcatagcccctccctctcagccctggcccctccctctcagttctgcctcctcccccagccatagcccctccttctcagccctggcccctccttctcagctctggctcctcccccagccctggcccctccctctcagccctggcccctcccccagccctggctcctctccaaaatctggcccctctcccagatcgggccccatccccaactacagaggcccccaggcctccccagaaggctccccctggcagggtctcaggccgccaaggatcaggctgctctcagggagagtggaccctgcagatgggaagggaagcactaggctggggaatggggcccctgaaatggaaggagctatgcttgggtacccagtctgggtatgggtggagccatgtgatcctttcttctgtaagttgggggtggcaggggcaggaaggtaacccggagggaacccctggctgcaagagcagggttggggggtcaggtgaaaggaatggggtatggggtggaagcaggcaggaaggctggaggcccctctctgggggcgtgtgtctgtccctgaggtccctgtctggatgtctctgtctgttgctgcgcttggcggactccagcttgtcctgggacactctatctttactgcactctgcagtcctgagctggggggccctagcagcccctcagcagcccctcaaggagctccggccagggggtctcaggctgctggggtctgtcctgagctccctcctcccgcagcatgcctgtctgatgaagcggctgtccctgaatggctgcacagcaagtggccgctcctctgcctgtgtggactgcgtcacccacatgggctttgagagggtccccggggttgttggcctgggttgcatggcaccgtcccagtccgtgctcctgggccctgcatggttggctacttctgaggcctgtgatgcccacagacctgcctcccacctgcctgtgggactggtgcatcaacactcctgccagtaggcagcctggaggggggtatcagaccctctgaggcctgacccttggccaagggccaccacagggcaggcctgcctcgactgttcccaagggctcatggggccaaggtgggggctggggccagcacgaggctgtatgggtgagaggaagcatctcttggagtccacttcacaaagatgctcaaagagttctgttctggagggttccatcatggtccctgcagtgctgggtgggccccagtgtctgggtgcccctgccatggctgtggaacttggggctggtgcctgggacagtgctgcacaggccatcactcgccgtgggttccagagagttggtgcccccgcggccctgcccactgccacccacctgctcagccccaccaccctgcggccctgcccacagccacccacccgcgcagctccccccccccccccgccacctgttttcctgcagacgtttgtgaatgacatgcgcatcccggaccagaagtacgtcacgctgaagctcaacgatgtcatccgcttcggctacgatatcctgcccctgagcgtccctcctcctgggcttcttctcagtccccaggaccacagtcaccctgttactccagaagcagggctgtcactgctggggttgctgggtaacagagcaccaaggatgaccctagggctgggctccacctgctgatggagcaccccaaggaatgccagtccctgcagcccggccccccgtggacaccctggccacgggtacctgctgcttgcccacccacccagcctgaggtcacatggggcctggggaactggtgaccactccctaggaccccgagtcctggcccgaccttgggactgtctgagcacatgggtgggcatggctgtgcctccccgggaagaaagaggcccctcctctgcctgcctcgatgggcccttgagctggcacacctgttgctgggcgtggacttcagcgctgggctcctggctcttctgctctgtgttcgccttaacacgtgtccacattccaacatgtatgtgctggagcgtgtgcagcaccgagtcccggaggaggcactcaaggttagtgctggccaagcccgggtggctcagccacgagggctcagccccccatcctccccaccatgctcccgctgccatctccccagcaaacactcaccaggcctctggggcgccctgttcaggctgcgggtgccatgagtcaggccagcctgtcctgccctgccagatggcccagtccggcaggtgggaaggtagtcattacccccagcctgctgcagtgacaggtggcgggggcaccgggacgcgggtgccactgttgtggatgcagcagcatccgggctctgggaggggcctgggaggagccgggctgcatggtcagcctgctggagctcctgggctttcggagctgcatcgctgggcactggcggatttagctgtggctcacagaacaaatggctcattgggtgagctgggtggccagagcccaggaagctgctggggtcaccctgcaggagagtgcagcggggctgaggcgggggccagcagcctccctgggagcagagggccccgttcagagggccaggagggtatagagcccctgagccccccagcatctttttgggagtgtctctcaggttaagtagctttggggtctcataaggggctttagattctctgacattacagttatttggagtcttcgaagctgaagggattaagagtctctagacagagtgtttagggtctctgaggctggggaatttggtctctctgtgagtgagatatttagggttccttaggctcgggggatttgaggatctacgtgttagaggatttggcgttcctctgggtgaagggatttgaggtctctgaagctgaggtgctttggggtctcatgcccaggggattaagttcgctccaggttaacggatttgagtccttcaaggtggcaggatttggggtcacttcaggctgagaggatttgttgcttcttagggtgaggggatctgaggtctcctgggctgaaatctgaaggtcttaggctgagggtttataagggttttacgctgcacgaccaaggccccccgagttcctgtcagtctctccgatctcctcccgcactgcccgccctggccgggtgccctctcggagcccctcaggaggtaacagctgcccccagcacattgatgaggccgccagcagggggtggccagaggcaggaaggaagggtgctggaggccgacggtggcagccttcaggggtgggcatccttgcgtgccctttccccggtgtgctggcgacacgcacagccggggcccctgtggggggcgtgagggtcctaggtgggaacggcatctcctcgccctcacttgttcatgtgggagttgtggagcacagattcagggccctgttcagagctccccgggagccctttggggccagggcgcttagcccgttcctcggatgatctccgagcagcctggggtcccccagcctgcaaggggcagggcctaagggagtcaggttctgtctgatggcacaagcggccctgctgcccatcccagggcccccactctgatgatcgcagcctgctctgtcctgccccacccaagcaggcccctgctttccctggaagctgcccctccccaggcttgagctggaccccgagccgtgttacctgggcaggctgaggctctgtctgctcttttggggagcattagggagagcttgtgacatgcaaagtcatagctgggccctctggatggagaggagaggctgggcccaccctggtgggttcctcctgaggctgggcccagtacctcaccccgcctggcctgcccacagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacaggtaggcccaggcagtgcggatggggtgagcacacagggccactgccaggccctctgccccgcacctgcctctctgcaccccttaaccctctgcatgcatataccatgtacacccatacccctcaccctttgcacacacctacccttgcacatgcacacccctcacccattgtgcacacctacccttgcacacccacattcctcacccattgcacacacctacccgtgcatgcctgcacccctcacttctgtacacacctacccatgcatgcctgcatcttcgttatacacaccctactcatgcacacccacaccactcacccctgtgcacacctacccatacatgcccatagctctcactgctgtgcacagacctatcatgcacacccatactgctcacccctgtgcactcacacccccacccctgtacacacatctacctgtgcacacccacatccctcacctcttaccccacacacacagctacccatgcacacccacactgctcacccctgtgcacacctacctgtgcacgcctgcaccccttgagcccacagttcttgtggggttggtgggccaccagctgggcaccctctgtccccagtggtgagaggcaggtgatgggggggtgaggctatgctccctagtatcaggcatttggactggattctgcagaccgagccagcagggctcaggggttggtggtttctgatgaaacctgatttgcgcctttggcagtcagtgcagcgggtaggcagaagtctgggaggaggacagctgcacgagggtccgcgtgggtccggtgggcacaaagggaagggaaggagcgagagtgagaaagtgcctggtggggtgtggaggggtcggggtggggtatccaagcctgaggccccagacttgagttctggttagacaggggtgtatccggggatcaggctctcggctcccacctcggtccaggaggggtcaccctgccacccccagctttggccccatgtctgctgtgttctgctgtcagcccacacatctgtgttgtacagccgcagctgccggtgtctggttgggatgcaggtccgcccagaatggaagaccgctggggactgggaagctttccagaaagccatctgagctccccagagcacctgtcagtgtccagactgtgaaacacatgcagctggtgacagccagtgtggggctgtcccggaggtcatgacaggtgcagccagctgggcagcctggctccttggctccgttagagcgagggcagcacattgtggggaccaaggaggagttcagggccggcagcagatggggactgcctggtagcagatgcccctgcctcagcagcccctgggtgtgtccctgggtcaagagggagtccccagggaggggtaaggcgtgtgtgacacatctcaggggccctgcatccccagcgcagtgtgcacatggttccctatgggtaactggccccagcgcagtgtgcacatggttcctgacgggtgactggccccagaccctctggccccccagcagtgtaagcagctgggggccatgacgcagaggccccctgggcttccgcaaggatggaaagagcttgggtggagggcccaggaaggagactgtgggcatgagggccagcgccctgacctgagggcactggacactgcttctgttcactgctgccatcaggaagggctgggctgccggcttctcagagggagtcaggagtgagattctatctgaaatatacaatttccctcctggtcattaaggcaaacaaactaaaatgccgcagggaccatgtagattgcagtggctgcccacccccagggccacccatttgtggcctgaaccatttaccagccttggaggtggctggacccaggtgtgggctccccctggcctcctgccctctgttggatgcgctctggggtcgggaaggccggggcagggttgcaggacggaggtggggggcccccaccatgccccaggggatgagcctctgagtacatcagaggggagagaggaggggccaggcagggaggaggggccaggcaggcagggagcctctaagcacttgtgggaggaggtggggccaggcagggaggggccagtgagccacctcggaactcaaggtagtcaacattccccacagaggcggggccctgggctgccacagggccaagctgggaggtgatgccagggcctgccccagagtccagcctctcctgggctgccagttctctgcttttcacactgggggccccagcaacacagggtctgacctctcgctccctccacagaggcagcctcttaccgcacacccctgtatgggcagccctcctggtggggtgaggacgatggtagcacgctgcctgacgcccagcgccagggagagccctacccaggttggtcttggggccaggctggtgagaccctgagggctcccagagggtggtgtgtgaaggggatggcctgggcttgaggagcccactccgggggacatggggcctgtctccccctcttgggtggagtggatggtcctggctgaggagggtggtggcaggtggttaccctgaggcccggtctgaagacatcttcccacaccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggtgagtgcccagctggcggccgtgccagtcccgggacaggcaggggaccggactttggctgggtctgcactgttgccatgcagaggggcccattcagctgggttgacttcccatttttcagttaattgcctaagagccacctgcctggtcaggagtccggtcctgcgtcttcccgttgcacttctttgccctgtgtgggggggccctgagggctggggtgctttgtcaactcagctaaggcatggggtgatgaggctgcctgagatcgacagctgtttcctttctctcggcctgacaaggtggggtcccctgtctcccccaggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtgcagcccagcggcgagtgagagccctcgtggggaacgggggggtggaggcgatgccgggggtggcgagtgagagccctcgtggggaacggggggtggaggcgatgccgggggtggcgagtgagagccctcgtggggaacggggggtggaggtgatgccgggggtggcgagtgagagccctcgtggggaaccgggggtggaggtgatgccgggggtggcgagtgagagccctcgtggggaacgggggggtggaggtgatgccgggggtggcgagtgagagccctcgtggggaacgggggggtggaggtgatgccgggggtggcgagtgagagccctcgtggggaacggggggtggaggtgatgccgggggtggcgagtgagagcactcgtggggaacggggggtggaggcgatgccgggggtggcgagtgagagccctcgtggggaatcgggggtggaggcgatgccgggggtggcgagtgagagtactcgtggggaacggggggtggaggcgatgccgggggtggaggtgggcggacgttgtcctgctccggcccagccctggctcctgcctctggcccagctgggcaggagggagcctggtatgctgcccacagccccgcccctccccttcccagggctgggtccgtatcccatccgcatgtcctgctgacagccaggctgcatgtcccggccaccagccactctggccaaccaggtccctgctctccctgtggcctgggggtggccagtgtcagtggagggttgggaggtgggcttctctgaccctcggtgcctgggaccatttcctcttggcaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccaggtacaggcacagacggccaccccaaggaggggctgggcaggaagagggcagcatccaagccggacctggggtcagcgggccccccatggggcgagactggactttcctctgagggacacgctcagaggagggtgggctggggcttccatgaggagggatcggggccaggtgtcaggcccactgttgatttgaggtcctgggcaaaacgggctctgaggtcaggacagggccacggctgctctgccaacctggaactgagttctgtgaggctgcctgggctgggcaggcagggggtcgcgttggagcaagtccaggcgaggcaactgggatccctggctgcctttgcaggggcacgcttgctcatgcggcaggccctgggtggcgcgcatgcgtggggctggtgttggctgctctggacgcccctcctgttccctggcaccccctgcttctcgccgttgggcttgcgtgtggaaacactcccaccctcctctccacagggcctcccggtgccgggctcccctgggggtcagaagtgggtgtcccgctgggccagcctggctgacagctactcagacccgggcctcacaggtaagtggctccagtgctgcgggggagtcgggccaggccggggcgggcctcaggccactgaccacggacacaggctgcctcttcctgagcgtggagggcctgcagaccagcggccctctaaccggctgcctttgtgctccacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccagtgagtgccagggcgggtgggaggccagggccaagacagggctgccagtgggtctgcagcatcttggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactgggcaggccttgcgtatggctggaggctgaggcagggttcgctggaggaaggggtggggcggggccgagggtcacccctgcttggtggagcctgctgtccctacccgacgtggtgcactggtggtgtttgacccaagcatgcggctcgccatcatgccccgctacagtgcaggagcgcagctgctgccaggcttagagcaggggctggtgaggaggccaggactctgcccaggagggcggaacctgaagctttgggtctgacaaactcaagcaggcagcagggagggactgcagtggccttgcttgcgctctgactggtccttgcctgtctgtgtggtccagcctgggccgcagcaggtcctggtggggaggtttactctgttttggggtctgtcaggcactgctttcccaccacctgtaagggggtttcccacctaatcagctgcagactgctcccgggttgcagccactggcctgggagcaccaggccgccttccccgcatgtgccctgggctggtgggggccttgtggtccctggagctcagcagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggtgagtagcccattcagagtaaatccactgggtgccagtgcgttttcttgagtgagagcaccctgagggcagggaccaggctgggagctcccttcttgagtggatagatggtacggcagatggctggctggctggatggatggacaaatggatggatggatggatggatggatggatggatggatggatggatgaatggatggatggataggagggtgggtgggtggatggatggataggagggtgggtgggtgggtggatggatggatggatgggcaggtgggcaggtagatggataggttgctgggtgggtggatgggtggatggctgggtgggtaggtgggtgggtgggtggatggatggatggatgggagggtgggtgggtggatggatggatggatgcatggatggatggatggatggatggatgggtgggtaggtgggtgggtgggtggatggatggatggatggatgaataggagggtgggtgggtggatggatggatggatggatgaatggatgagtgagtgggtggatggatggatgggtgagtgggtgggtgggtggatggatggatggatgagtgtgtggatggatggatggatgagtgggtgggtggatggatggatgagtggatggatggatggatggatggatggatgaatggatgagtgagtgggtggatgggtgagtgggtgggtggatggatggatggatggatgaatgagtgggttggtggatggatggatgagtgggtgggtagatggatggatgaatggatggatgggtgagtaggtgggtgggtgggtggatggatggatggatggatgggtgagtgagtgggtggatggatggaaggatggatgagtgggtgggtggatggatggatggatgaatggatgagtgagtgggtggatggatggatgggtgagtgggtgggtggatggatggatggatgagtggtgggtggatggatggatggatgaatggatgagtgagtgggtggatggatggatgagtgggtagatggatggatggatggatggatgagtgggtgggtggatggatggatggatggatgaatggatgaatgagtgggtgggtgggtggatggatgaatggatgagtgggtgggtggatggagggatggatggatggatggatggatgagtgggtggatggatgggtgggtgggtggatggatgggtgggtgggtgtgtggatggatgggtgggtgggtgtggatggatggatgagtgggtgggtggatggatggatggatggatggatgagtgggtgggtggatggatggatggatggatggagagtgagtgggtggatggaggggtgggtggatgcagatcttcccaggaggtgagaccgccagtacaaggagggcctcctcaaaggttttcattagaaatgaactccctcacatggtcattcagtaacagggccctctccaggccaggcgctggggaggatggggtagggagttgggtgggagtgagagtggtctttgccaagcagtggtcagtactgcaaaggcagtccctgaaaggctgtggggcaggcagggggggtcccaggaccagggtggatggcaagtgtttgttgtggaggatgctgagcttgaagcccatgagggacctggaaggaggtggccaggagcaggcggcccttagagagtggcccacactggggtggaggcgcaggcacctgaggctgtgagcagcatgaagttggtggggaggacctggggggcttggaaggatggggactggggacagggctcttgggatgcttgaggtattgggggagcatagggaagaaggctgccatcagcggaggaggctagcacagggctagggctctggacagagacactgcacctggctgagaagggggtgggtgcttccaggcctgagagcagaaggggatgtggggggcccatgtgggtttctggagttctctgccttccatggtgggtgagctggagcatgccatatgacgggggcaggaggccagggagtgctgggcgggggcctgagggccaggggcatgtgccagttggtgtcacccagaggtggagggagggcttccatgttttgtcttgatgtggaatggtggacccagctaggacccagtcctgaatggggccagggcagccagtgggatgtgcaaggccatctgggcagagggtgctgggggtgtttctctggtcgtgccagtgtctggcgagggttgtggtgccgctggaggtaggggtagggggagggccctcagggtggtctgttccttgggtgactgccagtgtgggggccgaggaggcttggggtggggcctgtccccatgaggatgggtggttggcagtgacagggagcctaggtccccacggcctgggctgaaggcctaagtggggcaggacctgctggtggcccaggtgcttaaggggccagcaggacagctgacgaggctgtgcgctccagcagagggctgggagctgctcacgggcccggcaggcccctgtcctcgctgggaagtgtctgttacctcggcagggtggaggcctgtgccccctgggcacatcctagggggactgagctggccaggcttgagcagggggctaggctgagctgccattggcctcactggcctgcaaggggtcccctccctctctggatctgcccagccccaccctctgcccagccccaccctctgcccagcccccaccctcagtgtgaggagtgccaggctgtagtttctgtggcctcagcccactcccttccttgcctcagtttctctgcctgcagagctgggcacccgtggcacccacacgttctatgactgagtcccatccatcccatttgggccccgcagctgtgatgctggccctggggggccggagagagaggaggtgtggcctgccccagagccagcaagggtttctgtgcacccttcttttcaggctccgtcccagccccccaccatccctccttgtggctgtggggagtttggcctccctttggggccgtggccagtgcctgtgtaaccagtggctaggccggtgtttggggccaggctggggagcacctcccccaggccccacctctggccagcagctgcctgggagctgggaggggctttgaggcctgtctggcccctgctgccccgacttcctctgtgcagaacctgccgtctttcctgccggctgcaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggaggtgagccccaggctttctgaggcccctgtgccagagccaccctcgaggagggtcaggccaggtccccacagccctttgcatgcctcggctgaggccctgctgcacatccccacttggcgagctggaacatgtccccctgggtcagcgccccaaacggccaccggagagctcgaggtctggggcgctcgtggcacctgagtcaagcctgactgtgccgtcatccccagcccagctgcctccatggcggggcaggggcacaggagggaccttgcacagacggaaggtgggtgtgctctgtccacctgccgggccggagcagggaggtgcagccacagcctggcaggagcctctgcctggggcccacggtgccggccctccctcttgcagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggcacggtgcccactaccgccacggagctgggtgtggggggagcaggggcggggctcctcgagggcggggccatgctgaggccgggctcttgcaggtgatcttcgataacctgatgctgaacccggtgtcccagctgtcgcaggccatccgtgagaacacagagcaccttgccgagaagatgaagtgagtcggcttcctggctgaggtggacgcccagacaccagcacagctgcatgagctgagactcagcctggctgaatccctcaagggcagcggtttcatgggtactcgtgtgcacctgtggagcagccctcccgtgtgcacgtgtatgtggctcccagcaggcagaccctgaactcagaggagccagcgcctccagggcggcccttcctccccttctcccctagccctcatcccgggcccagccctccccaccgccgagtgtcaggcacagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttg

SEQ ID NO: 1322 - DNA, 2519 bp, Homo sapiens
ctgctgcggctggcccactcctcatccctgcaccatggaggctctcccagaggcatgtcaaaaccccagcctgacgaccaagctctgtccactgcccaccaccaacagccaccacttgagcctagatgtgtgcacgcagcggcggcgtccacccaggaggcagaccccaggaagaggcctgccgtctgggaagcaggctcaggcctgtgtgggcagcaacctagacggaaggggctaggtgctgaggggccatgtcccttgagctggaggagggcacagcaaggaactctgcagcatggacctcaggacagagctcctgggtcggggcattgccggcctgcaacgcaggagcgggtcgggggcccgcactggtgagtacagctccagcgttggtgtgctagggccactgtaaggaggtgcctccaacggggcgtgaacagcagcagcgtgtggtcccagttctggaggctccagctgtccacagggctggttgggtctgaggcagttgtggggaacctggcctctcctccactctcgtggggtttgcaggccatctttgctgttccttggctggtggaggcagcgcctcaatctctgcccgaatcttcacatggtattctccctgcgagctgtgtccaaatttcccgtctttataaggacacagtcacacaggatcaggggcccacactcccgggatgactcaccctaacttgatggatcacatctgcaaagaccctatttccaaacaaggtcacattctgaggccctgggggttaggccttcaacatatgaattcgaggggacacaattcgacccgtaacagcttctgtctccccacacatccgatgtgcttctccctctgccacgcttaggctggggtctctaccaggcacctcgacccgagtcctcactcaggccggctctgagcctcacagctctgtctgtgggagctgccctagttttccacggacctttattaggtgacatgggaatatcgagcagtgccccagaatccctgggttttgacacagtgcttcctcctcacctgaggcagcattcccaccctcctgcagggatctctccgaagagattcctctgcagagatctctggcccgcggagctcccttctccagcggtcagctcggcagtgagcggccccacatggccagagggcatctctgctcctgtgtttgggaagcagacccacgttccccagaggaccgggagccaggactgccactcctgcgaccccaccttaccagagtgggaaagaaaaatccctccatagccgattagctgtcacggccactctgtgtaaggactgcagaggcgtggcaaggccgtgactggcgtccgtccacagaagccctctcacaggcatggccacctccagttcggcattctggcggtggggaaacggcctcctaggtcggtcccaggttagaagcctgttctgccccccacaggcctgcatctcagtgttaaggggtgcagtctccccgctgcaaccattccaccagtctgttaggcctcctgcttctaggtgaagggcgtggagtgagaccagtggaactgatggacacaagcttatcgccacactggttttcctctgaaacaaggccctggattacaagtgtcatttgtggaatcccaaggcagcgaaggaggccaaggatggcatgctggcgggagaagcctgcgaggacccgtccctttgaggatccatccctgcaaggactggctctcgacaaaaggcacgccgtgtgctctgcctgcttcctggaggctggctgccctccccacagggggtggtgccacatcagggctcagacaccatcctcgctgttggaaagatgggcgcccagctgtccatgctgctggaagggtctggtgggggtgaataggctacggagcctgtgtggccaccatgcctgtggcctcagccactttgtgcaaaggactgcagaggcgtggcaaggccatgatgtgtccgtccaccgaaggcctccctggttttgagcccctcctctgcagggaatgcttccagcattttcatggattacaaatgtcttagcccctgccctttcaagcagttccttagctcccctccccagtccacagagccatctcctgcctgtgagttaggcctaatcaacgtaaatctgtcctccaggccctcccttccctccagatgaggtgcgcaaccagtggtgctgctggacgtttgaaaatacaaaaggccgggcgtggtggctcatgcctgtaatcccagaattttgtgaggccgaggcgggtggatcccaaggtcaggagttcaagaccagcctggccaagatggtaaaaccctgtgtctactaaaaatacaaaaatcagccaggcgtggtgacgggcacctgtaatcccatctactcaggaggctgaggcaggagaatcgcttgaacctgggaggtggaagtttcagtgagccgaggtggtgccagtgcactccagcctgggtgacagagcgagactcctgtctc

SEQ ID NO: 1323 - DNA, 4117 bp, Homo sapiens
gccctccccgccggggcgcgctgcccgcagctccacgcgcgccagggccgccctggggagggcgcgcgcgcgagcggcgaccggagaggagctcggggcggcggaggtgagcgctgggggtgggctcccggctctgcccgccccgcccgcccgccggccctctccccgctccccgcggccgcgctgccataaatggggccggcggcggcggcatctggtgggccgggcggcagctggaggcggcgcggaggcgtggggcgggtggcggcgcagccacccgggcgtcggggacgccgcgagcgggcggccgcccgggagtgaagttcaggagcgcccgggcggggacgcgcgcaggtttgcgcggctccggctcctgcgcctgagtcccgggacccgcccccgcggcggagctgctactgtttactttcgatcgagtttttcctgctcggggcaggtgcccgcggcggctctggacgggaggttgcgcgcgtcactcccgcgccgctctttccgcgctgcctgcagccgggaagggcgcttcgtgggcgcctccaggcgcgctgacgggcgtcccgtttgtgcccaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctgagggtggggtggaagggaagggatgggccctcccaggtgggacacagcatggggtgtgaagcctgaccaggtggaggtccctgcttgggccagatggctccaccctcctggcagagagaatgctgcctcttcctggaacttggcctcagactcggtaacttgggcagccttcctcccaccttgcctctcctttcccctcactctccaactcattccggcccccaggctgtgccctgcctaggctgtgacactatcttcctctcccgtcccctccagccaagttctgaggggtgtccaaccagcacctggctctgcccccgtttctccgtgtgagatggcacatccatctcccggcccgggactttcctgaccacctctctggcaggcttggggaggtcttcatgagcctggccccacgctaggtgaattattcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggggtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaa

SEQ ID NO: 1324 - DNA, 31459 bp, Homo sapiens; identical to SEQ ID NO: 1321

SEQ ID NO: 1325 - DNA, 11517 bp, Homo sapiens
tgctgaacaaatgatgtttctaaaagataaaaatgctatacagaaacaaaatagtgctttagatttattcctataaaacacataccctttaaactagggtccatgaggattaactttcgacatcgggggctgtcagaggtcgtggacacccccaactccagccgggcgctgaacaatgtaaaaagaatttgctctgcaaccctgtgggggggggaaataaaagtaacccagcgtccatttaatgcagccaagtgcaattcctttccccaccttagaaagcaccaccagataatacagcagaactgatcctgcagaaaggttgctggagggtcaggccgtggtcgtaactaacaccacattcccattttgtttgctggataattttttaataaagtgaggtttacatcactgatatttaagaatggctatatgcacaaaagaaaacacacctttttggttaaggggtgaggaagttagagaaagcatgagaaacagggagcatgtggggtgaggcggggcaggagtggaaggctgcaggcacccccagctcactccctgcctgcggcagcacccatgacactacagatcaaggggttatgaatgacatggattcagatttctttcattctagacttcaacctagccttaaccttttgtttcagcaccagtctaacagagcagcgcaggcgtttctcatccagcagcaatgctacttcctcacccagggcaggtgcatgggctgaccctgatgggagcctccaggaacactgccttgagaaggcaccaccgaggggctatgaggtccctgaagaccaactggtgcctgtgatctacaaacagacaaatatttgacctttgtcttcaatgacatttacatataaatagacataaataaaatcctccataatttactcttaggtctaggaagatgtggctgtgtgcggctcctgattttcacccaggtctcactgcagcgcaggacataatgaagaagtatcacacacacatttaaagtaaaacatgatacattcacactgttgactgagactgtagtgatgctcactgcaaaaaacaaaacaaaacaaaaaacccttatttaaaccttaaaaaaatgaaacacaccaactgcaattgtttaggctataaaagttctaatgtagcagcaaaggatgtttatagaaaaaatatacttttaagaaaatagctgaaaaaatctaaagagataaggtataaaaagtttaaaaaatatatcttaagacaaaatactgcccaaaacatgtaaaactgaattgtaaaaattcacctatctaaaggtaaaaggaggttgatgcagctgcggctcaccgtcctctacagtgggggacacaaagagacacgaggggcccagggctgtggggacgtcagaagacaagaagccttccagaacagcctctgcctggcgctccacaggggggaggtgagtgggacgggcctagggctgcagccccactggtaatgggctgttctgggatttctcagaatcagcagacagggcagcaaggctgggccgctggcggcaggcgcaccctccgtgggagccagtgctcacgtgtcaatgcgtcagaggcggctgtgagcactcagggctcctgctcaggtctccaccaggatctccaccacgtggtccagctcgcccaggtcggacttgcagctggagctagggcctggggtggccggagccaagccctcgagcccttcgcaggggcccggcctggcaccccccatcatgcctgtcagtactgtgtccaggtcgtagtaggggctgtccacgtctgagaacagctcttccatgcagctggggtttttagtctccagcgtttcaaatatctgatcaagtgacttgtgaaagcttcctctgttttctcgagggccatccatctcccaggcgctgctctgcaggtgccttggtgcctgtgctgaggtgactgggcaaaggtcagaaactggaccctgtgtgtggccgtcccccaagccaggagcaggatgtgccccctcttgcccccacgctgcacggcacaggatctccgtggagaccaagcggtcgagcggcgcccgctctgcagcctggggtgccactgtgcgccacgtcccatcctgcgtcatctcctcttggatctgccggaccgtgttggcaatgaggactgagcggcacaggttgggctccacaagcatgtggcaaagctgcaacttcaccagagacatgtccaggagcgactgccgctgcaggctgtatgaggacactgtcttcaagccggccagggctccctccacgtcttcctcgtggccaacacatttcctcttcagtcctcgtgcaaacattgtgtcctgcagaaaccaaggaagacaccacttagcacacggcagactctctgcggacagcgccccttggatttcgtctgactgccctcactgtacgcaaggagcagcgactccgtaactggcagggacttgacagagctgtaactccctaacagagctgagacgtggagcccagtgggagacccccacccccagatcagctgccatcctgcctaagccaggcacagtcacgttgttagaaacgacaaacctctcaactgtaccacgacagtgttttatagcaaaaaagataaatgaactaaaaataggagaaatatataagagaaatgtaagtgttcgagagcttggctgaaaatctgtttcaaaaatctaactgtggtgtgtacaaaagaagagaccctggggtaacatgagattaatgtgaaccgtgccagcctgcagagggcgcagggcgggggccggacagggccgggcacacacacgtaccattctgacttccctcaggatcctgcctcggacaaagtcacttctgcgttcagaagagttagtgccttccccctcaatgctttcactaaaagcctctatatgtcgcagacagccgggctggaaagctgtgccaccaggaacgcgcaggggaaggactgcagggctgtatgctcatcccatgcagcgagtggtctgtgtttcgtgcacaattctccaagggacacagggtctcctggccgagcctatgtggccctggacagtcccttgctcccacacccgcccatgctgcctgccttagggatcacacccattccttggctccccccacccgccccaccagttcatttctcccaaggtgcacaggctctgcctggctgctttctacttgacatctctcaggtcaatgccctccactcgagagctctgaccagcccgtacaaccatggcctcaggggccacctcccctctcatctcaactcctttctcttcaaaggaaccaaaacatggcagggtatgtgtgtgtccggggcagggggggtgggttcctcaccagtgtgttgtggcagcccagagctggccaaggcagtgtttctcggcgtatgcctcagcactggcgctgttggttgaagatgcagattcctggatcttaccccagacctgggcaactccgggatggcacctaaggctcagccttgctgggcaggttccactaagacgcacagcacagatgcactagatggacattggccatgtctactctcagaagtacaagtctgtgcaaactgtttttttttttttttaactgattctaaattgggacatctctggggcactaaaggcagagcagacaggagggtgggctctggcttttgacagatgccattctgagccagtgccgcctgcggggagctgggaggatgacagctggctcagggccatactggccggcagagtctgacaggacaagcatctcacgcatgattaagtttctctcttctcatgcttgtaatgtagtgaaatattatttcaaataattcaagttatgcataaatagggttacaatcttttgaatatgcaaactttggaacttctttttctcttagtcaatctgatggctccctgtgaccagggtatacccaggtgctcttggaaagctggcgtatgggaggcacatgctgtctctgctcggggtctggagaccaaggatgggaagttttgcagtgcgggagaactggctgccaaacataccccttcccaggagcccctctggaggctcccacctgctggtcctacccttgaattaacagaagaaagggtccccctgttctctgaatttcccttcagtgtcacagatctcatccccgtgcctttaacacatgtaaattttaaaaaactaagtgacctcttgggcatttatcccagagaaaaagccaatgttcatgcaaaaaacatgttccagaatgtgcacagcagctttatttgtagtagctccaaatctgaaacaaggaaaatgtacccttcacctgggcacggtgacacacactctgctccattcatgccaccaaatcctactctgcaatagaaagaaatgaactgttgatacacaggacggatccttccacaggggcattaggctgagggagaaaagccaacctcagaagggtgcttgctatgggatcccatttatgccacattgtcatgctgacccagagctgaggggtggcagggctagaaaggaacctgcgcagggagatcttgggggtgagggcccttctgctcctgggctgtgggggtggccctaccctgactgcacagcgccggacacgcacacatgcgcctgcggcagccgtgtcatcacacggacctggggcctggctgtgcatcctacaaggatgccggccctggggagcagaggaagggcacataggacctcctgaacactgctctgcaacctcccctggctctacaattatttcaaaattaaaattaaaggaaaacttccctaaccctagcttatttcccctacagcacccatttccccagagcagcatgccagtgtcaccacaggcacagccctcaggctgggcaccgcctctcacacctgcatacaccagcttctcaactaattctaaatgaaggacagtttaccaccaaaacacatttacacatttctattacttttggtaaatattcgagttctttgtgtcagccacaaatttaacttttcagagcttttccatcccaatccattgtttaaatcactggcttaaaattgctaagtatatcgagaattaacataaggctatgtcaaactacaaaggacaccctgcgttggggaaaagattaagtcccacgggttcctctgtgggaagtcaatataccttttaggtttttagtttctctttcaacctatctcaatcccaagcctgcatagcaatggattaatttaggacccaaaccaaatcctcttgaacagcatgcattaagcccaagtttatagacagaagaacccctggctgcctcccctgactctggaaacccagcagcacaacccccataatgtggggcctacaggaggtcagcacgactgagcagggcaatcagggcaactcacagaaggaacaagaataccaatgggacaggccaagaagacccacaaccacactgggaaccagttcaagaagctgtcccaagctcctaggaccctctgggtcccactttcctttcctctgagtccttagaaatgccaggtcctgagtccaaacccaacgacagaccctcccgcccttttctgaaagccagatatggatactagaagcctcccactggggatcttaagaggatgaattcagtgcttggcctggtgctgtcagcggtcctaagggcagcactagcaatacgtgaccgtcagaaatcaccctaataacatctgctctgagcgagggaatataccaacaaacaatggcggaaccacatacagaaacagaactctcagccattatctgccgccatcagtcggaaaccagccctttaccttcagtaacgggccaggaagccaggttgccctagtcagacctgcaggaagcctggctgctttctctaggaacaatccaggaagctaaacaatcatttccatagcaagcagcccaaaatggccaggacatgattagtaaccgacaacctctccagtttttgtccctgcttccaatttaggaccaaccagagaaagccaaacatgttctaggccatctcacaggagccccacttctttgttgttgttgttgtgtcgcccaggctggagtgcagtggcgcaatctcagctcaccgcaacctccgcctcccaggttcaagggattctcctgcctcagcctcccgagtagctgggattacaagggtgtaccaccaggcctggctaatttttatattttcagtagagacttaccatgttggtcaggctggtctcaaaactcctgacctcgggtgatccactcaccttggcctcccaaagtgctgggactacaggcgtcagccaccgtgccaggccaggagccccacttctaactggccaccccagtcccccaagtcagcagcctccatcagccatccctgagcttccctggattccactgtaaagctctcctgttccctcacctgcctatgagtttctgccaatcacgagagaggagggccgcacccttgctaggggaagctctggataaacagcctctgcctgttctcacctggttgcttatttccacagctcaccatagacaatctggaagagcatcaaaaaccataaaacgaattttctcccaggatcccatccactcagaaaaacacagtcaccacctgggttcctcctttccagtcgtttctcccagcactttcctctctgcacaagggagggaagtttcacactactgacaattttcccaatcacaaatgataccagtttctaactttaggtgttttggtatttctagcatttggcttccttagcctcggctctttacttactagggtgatgtgcaggtacatttttaagaggcttgataaacattattaaactgcatcctaagaaggtggaacgctccaccaactttctcccgcactatttctgcacacttgctggtaaagcttcctcttgttttgccaagtctctaagccccacagctaagcgttccttccctcctccactgagctccacgtctgtgttcctaccctgttccacggctgctctcctgccaggaccagacaccctggcctccctgtgtaggtccttttctggccatgccacccttcagctctgggtcagcccaacaatgtggcataaatgggatcccacagcaagcacccttctgaggttggcttttctccttcagcataattctcttgagatccttgcaaactcttgtgtgtcaacagttcccaacagagtaggatctggaggcacagacggagcagagtgtcaccacaccccagctgaagggaactttttccttgtttccagtttggagttattacacataaagctgctatggacattctagaacatgtttttgcatgaacattggtttttcatttctcttggataaatgccaaagaaataatcgttttataaaatttaggagtgttaaatgcacaggcaatgagatctatcacaccgaaaagaaattcagagaacagggggaaccttttttctgtctattcaaggacaggaccagcaggtgtgagcctccagagaggctcctggggaggtggggggcggtccttggcctagtttcatcactctcagttgtaagcattctttttttttttagatggagtctcactgtcgcccaggctggagtgcagtggtgcaatctcggctcactgcaacctccacctcctaggttcaagcgattctcctgcctcatcttccctcaacttcccgagtagctgggattataggcgtgcaccaccacgcccagctagttttttgtatttttaatagagccggggtttcgccatgttggccaggctggtctcgaactcctgacatcaagtgatttgcccacctcggcctcccaaagtgctaggattacaggagtgagccatcacacccagccacaagcattcttttaggacttaaacagcccgggcacagtggctcatgcctgtaatcccagcactttgggaggctgaggcaggcggatcaccaggtcaggagattgagaccatcctggccaacacgatgaaaccccatctctactaaaaatacaaaagattagtcaggtgtggtggcacgtgcctgtagtcccagctactcgggaggctgaggcaggagaattgcttgaacctggaaggcggaggttgcagtgagcagagattgcaccactgcactacagcctgaacaacagagcgagactccgtctcaaaaaaaaaacacacacacacaaaaaaaacacttaaaacaagttgaatgtatacgatctggtgtattctgacaaaggaatgcaactcagcaacatacctcaatgatttatgcaacacggataaatttcaaaacattatgctgaataaaagcagcaagacacacacaaaaatatgtaccgtaggattctattgatctgaaccttcaggacaggcaaagctaatctaagttgtgaaaacacagaagggtagccaccatcagggtgggaaatgctacaaggggccagaaagaatcctccaggatgatggagattctctctcgccccttgtaggacttgtgtaacccagggacctgcatagatgtgcctgggttacacaagttctacaagggacgagagataatccccatcatcctccactgcatctcatcccatgcacagatcccattctggtaccaggagaatatccctgttcagtcacttcaaatcattcctctccaatgttccaaatctccagcagctgttaattctgtgttgtacccaatattttaaaatgctgacaagtttattactattaatacaaaaaagagtaaagctcacaggtgctttttacagtcacgtgaccccaaagagctgtcacccagaacatgtgttcaggagtgaagaggataaggttgggcccggagaagctggcctgtgaggatcaccctgaattgggttatatctgtgtttgggacaaagtcagcaagagcatggtcttaaccagccccgagggatgcctgggctgggcccagctccctgagggcctcctgtgtgacttctgcctgaggctgcttaactccttctaatatggaatgagaaagggccctataccataccggtggggctgtggagcctagctccctgctcaatttttttttttttttttaagacagagtctcattctgtcccccaggctggagtgcagtgatgcaatctcagctcactgcaacctccacctcccaggttcaagcgattctcctacctcagcctcccgagtagctaggactacaggcacgcgccaccacacccggctaatttttgtattttttgtagagacggggtttcaccatgttggccaggctgatctcgaactcctgaactcaggcaatccgcccatctcggcctcccaaagtgctggattacaggcgtgagccaccatgcctggccccctgctcagttttgaagctctttctacacatctagttaaatgcctaaaatcccaccaactccacaggttgttaccgggacagccaagccctcagtcaactcccagcactgccctcaggcttctaaaccaagcaccgaccagacagagaaaaacgaagagggccagacggactgaggacatgtccgacatggcaggtggaacagccaacaggccactagggacagagcaacctaggcccaccgaggcagaggccagcagggagcagccccgcagtgctgctcaggcaagcagagtacagctcggggactggtccttcactacagcagcagtggccacaccttcgtggctgagcaataccacgaggctggctgaaaacgcagattcccagattctgatcagtagggctgggacggttggggacagactcaactctgacctaacctgtcaccttcacagctggacttgcagccacttcaaagtttcgggtttttaagcaaatcatcaacaatttccattcctcacacatcagataagctttgaaatactttatcggaaaaacagggagaagaggagcaaggtctgcagtcttgagtactgagtgggagctccaccttccactacaagtctcctggaggctgttcatgaacaattactgttatgttaatttcaggtatttggttttttttgttttttgagacggagtctcgctctgtcgcccaggctggagtgcaatggcacgatctcggctgagacctctgcctttctggttcaagcgattctcctgcctcagcctcccacatagctaggattatgattacaggcatgcgccatcacgcccagctaatttttgtatttttagtacagacggggtttcaccacgttggccagctagtctcgaactcgggacctcaggagatccacccgcctaggcctcctctcaaagtgctgggaggtgtgagctaccgcgcccagccaattgcaggtacttttgttacttggaacgaaacacactccttcttttccctgaaaacatgttccagtggcaagttgagggaaacttcctagccccttttccaagatacagcctactactcttcctagaaaaggggtgtaactcactttgtattctggatttccaccctaattataaaacacggtgacacttgaaaatagagtggttgtacgtagaaagttgataaaacgtaagttttgtgaacaggcaatgtttttctgtggctcgctttgagagaacggttatctgggtcccgccgtcccgtgcgtcccacacgaaggccacaggagaagcgaggcagcggagaccctctattccagcaagctgtcggagcctttgccacgacgatcctgtttgcggggcgagaagcgtctgaagacgcggagggaggcttgcgtctgacttctgcaagtgtctcggggactttccctagtcccacctcgcaccgccggaggagcccagggaagacggcgctggccgacccgcccggggtctgggcctcctcccacatccgcggccctctccgcggccgggctccgacagagggggctgcggcgcgcctggcgttccctccgctgcaactagagccgaggtacgggaaacgccgctgcgtaccccagccgggccctcgtgaagcggctcccgcgtggggccgcccgcaggcctcggcaaagccccagctccgcgctccgcaaggaacgcagacggcggcccgggcccctctgttccccgggccccctcagcagcggccaccccgcgggggaaccagcgcccaggagggcggcgagggcgccgcggcagccccagcggtggtcccgggcgccgcctccgccccggacccagcgccaggagccacagactccgcgcaccgcccccaggctcctccgcgccctgcagcacaaaagtgcacgccgccgtagacgccctagcggtccgccgggcccgctcacctgacccgcgaggccgcccgccgggtcctctgctcagccaccgccaccgccgctgccgccagcttcccgccgctgaggaaggagcgcccg

SEQ ID NO: 1326 - DNA, 9241 bp, Homo sapiens
cgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgaggtatttctgctgtgctgtggtcaccatgttgagtgggacgtgtacacaccaagaggcctacagccctcgaatgctgtggcgtgctggccagggagggggctgacagccccagagcgtctgcttctctcctggccttcgtccctggccatgtggttggcagtcccatcctgaggccagggaagcaatgagttggcagaggaggctgcagaaatgggtcacacgaaggccaggtgggggccacctgagctgggtcgctctttctgaccattcctcccccagcctgtccattccccattggtgggggctgcactggccccagctcagggcatttgaggaggagctttttgtctgaattctgaatctgctgagttcaaaagtctcagagattctaaaatcacatgatcacatttcaacttgcttgtaatgaattgggtgacgcgggatccaacctgtccgggagcttgtaatgaattgggtgatgcccattccgacctgtccgggagccagggtcccagccttcaggcccctgccccctgctctctttcagagcagactgtgggtgtttaccgtttggtgacacttccgctccttctcttttcctgtcttcttccttccattgttcctctttctctgccacttcttcccaaatggttcatcccaagcaccatcatgagagatcagaaataaaaccagtgaggaaggaaataaagatattgtagttctcagggctggcctgttttctcttccttttctttttttttttttttttttttttttttttttgagacagcctcactctgtcgctgaggctggagtgcagtggcactgtgtcggctcactgcaacctctgtctcctgggttcaagcagttctcctgccttagcctcctgagtagctgggattacaggcatccaccaccacgcccggctaactttttatatatatatatatatatgtatgtttagtagagactgggttttaccatgtttgccaggctggtcttgaactcctgacctcaggtgatccgcccgcctcggcctctcaaagtgctgggattacaggcgtgagccaccatgcccggccggactgttttctgaagcagtttccctggaatcctgatgagatccactcttaatagagtaaggtctgctgtaatgcttgttttgaatacaggatttgttttccagcgtgattgatgtattagggaacaattagagcatagttgaaatttcacaagaaagagtagataaatgcagaaaactgcccccagctgagctggggcccgttggaatacatgagactcgcacacgtacaccctcacacagcgcttagtgccccaatgtagcacacctgtcaacacctggtgttaggacttcacccggttcagaccaccctcctcctaccccttcacactaactcagcctgcgagcctttgtcttttccaaggtaaagtgctgtgcttactgtagtatgtataatttctttttttttttttttgagacggagtctctctctgtcacccaggctggagtgcagtggcacaatctcggctcactgcaacttctgccccccacccgccggattcaagcgattctcctgcctcagcctcctaagtagctgggattataggcgtgtaccaccacacccagctaatttttgtatttttagtagagatgggggtttcaccatgttggccaggctggtctcgaactcctgacctcgtgatctgcccacctggggctcccaaagtgctgggattacaggcgtgagccaccgcgcccggccgcatgtataatttcttaaccaaactggaaaacagcactgacattattgggtggtcatcttttttcatgtgtcactgatgaagtttgaatgttttgccctaaccccacctttcccatgagtcctctggttttgtgtgattttgctaacttggtgatttttaggaatgaatatgtcaagtgatagtaacactaatggtatgatcaattacaaatttcatttctatcacaattatttctttggaataaggtaacgttatgtatgtctttctcctaactttggtatgcttttcttcttttcttttcagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgaggtaagttggcccaaggccccagagggaggagggaagtgaaggttggggtgagctagcttccctgtccctcggtgtggtctgcggagtgggtctcccagcagccaggggagagccaggtcagcctgctgatttttgtgtctctgagcaggcctggactttcagagagctctgcagacaggccattctgggctccagccctggcccaccgtgtcctctgctggggtccaaccagcacctgccccagggtaccctctacaggggcttgaggacagaggcctggagcccagaaggccgcaaccagcattgcccagatggcccgtgtgccctctgtgtgtggtgcttctgcaaagcatgatccctggggaaaaactgtggagaatgtggtcccagcaagctgacggtgggggtgggctctgtgctggcagcattgacatctctgtccccagcagcacaactcgcggacccagaggcatggggagtcctgggtgtcaggacttggcggggctggacactcgtgggacagaaggctggatggtactttgggggtggagtagagcatggtttgtgtgttctgaaacactggggtatttttggaaatggtttggtgtttagcacatttgctcttcttctgtactcatctggagtgcagtggcaccatctcagctcactacagcctccgtctcctaggcttaagcgatcttcctgcctcagcctcctgagtactgggactacaggcacccgccactacacccagctaatttttgtattttttgtagagacagggttttgctatgttgctcaggctggtctcaaactcctgagctcaagtgatttgccctcctcagtctcccaaagtgctgggtttacaggtgtgagctgccgcacctgcccttgcactcattttcccttccatactagaacgtgaacttcctgcaggcagaccttctcagtccctcacagtgcgtagcagtgacgtgtggcacatagtagacattcaccgttggtttgctcatttgttctcctgagcatgcactggtactcgtagtttgggagcatctgttttgtactcagcacagttctaggcacttgagtgaacaaaaccagcaaaatatctggtctcacggagcttccactccttggaggagacagtaacggcagtaagtcagctactccagggcaggtgctgtgaggcatagagggggcacgggaggtgggttggggtgttgaaggatggcacgtgttgtttgaataaaagtataaatgaacaaataaatgagacagcccagtgctcctgcagggaatgctgtttttatttgtttttttgtttgtttgtttgagacagagtctcactctgtcccccaggctggagtgcagtggcgcgatctccgctccctgcaacctccgcctcccgggttcaagcgattctcctgcctcagcctccccagtagctgggatgacaggcgcccatcaccacgcccggctatttttttgtatttttagtagagacggggtttcactatgttggccaggcagatcttgaactcctgacctcctgatctgtcagcctcagcctcccaaagtgctgggattacaggcgtgagccactgtgcccagcccgggaacactgtttttagagttcttaacagccatacgcctcttggcttgtgcgcgtctcggcttgcgggtaaaggccaggcgccccgctgcgtgcctcgggccgtgcctcatgatctcctcagaaggctctcaaggtcaccttttaacaagtgcatctgttttccagtaacgaatccagaaaactctggagagcccttcagagcatacacaccacgtctacttctcagcgcctctggagcgagtcccgttgccaggagaacttctttcttgttctcggaatagatgctgcgcagaaggtaggcggtttgggttgacacagggctcctgggagtgtggttgaacttcactgtcaccagtggcccttggccgcgcccaaggggtgggtgcaggcagaggtgtgggttcaggtgggttaaagccactaggtggccccataaacgtgtcagggccactggatgactcccgaatgcttgaggcaggagccagcaaagcctagagcaggaggtggggaaaggctctggaaggaacgggcctgagcctgcagcagacaacgcattcagagatgtgcaacagtgtgtgtgcactcatgccactgccgccgccacgcacatgccaccacgcacacgccgccacgcacacgccgccacacacacgcctcacacgccgccatgcacacacctcacgccaccacatgccgccatgcacacgccgccacgcacacgccaccacgcacacgccgccacgcacaccccgccacgcacatgcctcacacaccaccacatgccgccatgcacacgccaccacgcacacgccgccatgcacacgcctcacacaccaccacatgccaccatgcacacactgccacggccaccactcacacgccaccactcacatgccgccacgcacacgccaccaagcacacacaccacacacgccaccacatgcgccactgccacgcacagactgccgtgcacgtgctcaagctcctgggctgtcgcagaaaacgccagtcatagggagggccgccttttcagagatctagatttcaatgatctttcctcattcttaaatattatggaaattttcaaacatggaaaactcaaaaagggccagccaggcaggcagattggccctggtgaagacaggggcatgaaaatggttgccctgttggcccatgggccacattgggctggccaggaaggaagtgaagggcagaaaggaacagagaggctcccagtgagattcgccctgactgtgtcattgtgtgaggaaaacagagaaccaggaggctaggaaatgggggaggcctgaatagaagcctcaggtgcgggccagctccgagtggcggcagcctgaagggtgtgtctgaaagtggccgtgaagacattattcccattgagcagttgaggggcgctgaggtcctgaaggggagcgaggcctgtgagccgggcatgaggcagcgagtggcagggcgacacaggggaaactggtgcgctgaccttgagaggggcctgagagaactttgcagttttagcatgaaattagtagaggggctcaggggaaaaggaaacaggagacaaaatgatgactgtaccggctgtctgatggggtctgtctccttagaacctttctggaggccagggccacatcatggaagattgtgacctcaaagagcctgaaggactcctcactgtcagcagcttctgtctccagcattgcaaagccctgatccagaccaaggtgagtggtcaccaaggagaggcctcagggaaccgcgctggcggtgtccacacatgtggagccctccgctttctctgatgtgagtcagttgcttgttttcttcctttaagtcttgtggacttccagaaaacaaacatttgtgctatttagggcagacaggcaaattgtgaacaccactgcagggtgccaaggaatataaataccatccggaaagactctcaggccagaggacccaggatatgggtgggtcacgcaggagaagccagggagagaagagagctgcagggaagctgagacgccaggtgtggatgacgaggctggaaggatgaggcaggaccaggctgtgactgttgggccaggggatgttgactccgcctgggcagctgtcgtgaacggatctgactggcggcttcagtcacgggccgcttaccctacacagggtctgcccacagcttttctctcatgagccgcggttcttgccacagagtcacttcatcacatcatcacagccgggctcaaggcagaagaggagatgggcagagaaggggacttcttcttgcagctctctcttttatcagggggaagaaaagcttttctgggctggagtctggagcccaccctcagaccaagtattgcaggaggggtgagatggccaggcctagctcacctggtttcctgctcaccctggagacccaggaccttggaacagtcggggctcattgtgtacacccaggagatggtgggaggggcgcatgggcggctgtgagcatgaagagtgacatgcagggaggcgcaggggtaaagtactgccctgtggcctggtaggaggtaacaaggacctgagactgagctgggacagcaggaaggttgcatagcacaggaggcagccagggtcagcttctgggcaagaattaggcatgaatgtggcactgcccccagctgacatggggtgggttccctggatgatcagcacacaggtgacaggcgacaggtgccatggggcaacaggagagggccctgatcggccgtcttcacaggctgtccatctttttgaaaagcaccatagcacaggagggttatcctagagcagcagctgtaaagaaatgttcgtggctgtgttgttcacagcagccggtgggggagacgtccagccgcagctgtttgggggaagtctgtggtgtagtccaagagtggctactggagggctgtgagtgtgcagggtagtggcagcctccaccagggagtgccagacacgtagcacaagggccagagaccccgcctaagatgtgggcccactgctgtcttcggggctggctgcaggccagagccacagactgcaccatgaggaagccccagcatgttttccctgggcgcctctctggtgacatcccatgatgagaaggtttctaagaggagaaccaaggagagaacactagggggccgagaggcagggggcggccaggggcaaacgcccaagctagcgcttctcattgcccggggtgcgcgcgcctgactgctgtcctctcatctcagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataagc

SEQ ID NO: 1327 - DNA, 11517 bp, Homo sapiens; identical to SEQ ID NO: 1325

SEQ ID NO: 1328 - DNA, 41105 bp, Homo sapiens
tgggatgcagcactttctttattgcccatccagggaacagccaagccagctccatctgcattctggctgcagcgtgtacattaggggactcaggggccacagtgtgggaccgtgcacactggcaaggcactggcggatgctggcaggccagtggacatggatagatgagaatgacaactcacagatgtcctagcttctgctggcccagctgccagccactggccatcacccttttgcccagcatgtgtgcattgtcacccaaaacatcttgaaacttgccattagtgaggcattcaacaaagaagtaagctaagtgagtaggaaacagtgtttcctggaatataccgcactctgcctgaaataggaaaactatgtttgccgggaagcagcagcagcaggaaagaagttataccaaaaacgacttgtacaccacagacattataaccctttcctcaaagaaacagtcatgttctgttgggtattatggacaggtctctggaaatttatctaataaagaccaacaaacttccccagcagtgcctctgagtaccgtgtgaattctggtgtcttgtggaagtcagggtgccttctttgcatccaaagctttgagggagctgggaagctttggttccattttaggagggctgtgtgatggtgacaaaggtgttctggtcatttctgctctgttctccgttctgtgaagtgaggtggatgtaatgtgctgtgggatggggtgctccatatgtgtgtgtagcctttactttccaacttagttttttgcatctctcttgtactgatgagccatacctctcagccttcatttggtcccaggcctgaccctttgctttcatcgtcagcttttctgtcctgctcgggcaggattaactctgttcttgccgcggatgtcaccatcactctggagtccagcccagtgcccacaggcccgatcagttcaccctcttccttctcttcaggggagaaactttctcgggcatcaaaaaacgtgattgtttcttcttgaagtttttgttcttccagctctgccccatcttcggtgcttttgcttttcttggtaggagatgaggagaaccctaatttgggaaatcggaaccagcctgccttctcctgttttttaggcagttctgcctctggtcgtgcctcaggctgtgtttgaatgggagcagatctctggacgtcatttttggaatcaacacctgtctcatcaacagaagaggaaaacccaatgtttggaagccaaaaccagagcagaccagattttttactttctggtttgtcttttggagccctgccttcatctgccagtggtgtggttgcctcttggctatcatcagggggaaactcaagaatttctgctggctcctcatctgaacagctgtctgcaagctggtggccagaaggaacttcaaatgtgagtgtttgctgtcccagtacattgacgctggaagagatcatctcaaatggttctccagtgtcaggctggagatctccagaaatggagtctactcctggggtggcttgtatgggagcctcttctgtgccctcctgagtcctagagtgttgagtcattgttgtgtacactctagcctgcgtgtggggctctgggattttcacttttaataaggaaaatccgtacgaaggtgtttgaatctctgacgtggggatctctgattcccgcacaatctgagtggaaaaagtcctgggtactgagagatctacaaactctggtgtcactatgctgtgtatagtgacctcttgactttcaacctgagcaccctgaatatgcactctgacctttgaaattgggggagcttccaaaggcaggttaaggtccacaggctgctccccagggaccccagcacctgccttcaggatgctggctccccagagccccggactttccttacaaagggctgtatcaatattggcctctggacactgcacttccctcacagtggggatgaacacatcatcctctgagctgggggcagggaaggagaaccttggtaccattaatttggggaatttgacagttaggacagaatcttcccacagttgatccacattaaccacagaaatctgggatggcatatcagtacttgaagctttcaatttaagtggaccttcaggctgggaagaccatttctctgttttatcctccatgctggcaaggtcatgtcctggcttggaaagaggagtctcatctatttctcctggaagaacctgggtttctggaagcctcatgccaggcatctgaaaagggagaggtcctttggatggatggatcctgacctcagaagtggaaagctcatccccagtcatcccagcagtggagaggtgcagcttcaagcctgtgctgtcaagatcacaccttagaatatctgtggatgatttgctctcagaagctgtcacttctgcatctgcctctgggagctgtagggacatagctgcctccacgtttgacccagaaacaaggaactctttgactttagctgctgcttcaccccctgttgctgccggtgcctgtgtctgagccacttccagctttccagccccgcctctgtccctgaaagagcgcctaaggctgggcatgcggaacttgggcattttaaaccagctttcctgcgagtacttggtcatggcttcctcctctgggctttccactgtgaggacttcagcatctggttttctacaggatggctggaggggatcttcaggtgtgggggctatcccctccccacaaggctggctcactgggacatccccgagcccacatcctctgctgtcaccttcggtagacagatcatgtttgggaagaggcaggtcagcttcaggctggctcacctccaccttggccttggaggatctgagatcaggtttggcaaagcccaaactgggaatgtggacctgtggccggtggaggttcacaccctcacttcctgtggcacttgctgttgcaccaagtcctcccctaccaccgtcactgctggccttttctgtgtcttgaaagctaccccctgctgtggcactagaaagggaaggatccacgtctctctgtggcaggctgaccccactcttagaagccttcattttgggaagtgcaagttttggcatggcaaagccaggctttgtgctcctccccttctctccatccctctcaggaggcagatccatgtggatggcagactgcggggccacttcatccttgtctaaaaccaggctgagttttgagtcctccacgctgcattctgggtccacctttggccctgtttccttcttcggggaccacctaaatgatggaagcttaatcttaggcattttcaagggactccctttcccttcgtggtcagcatcttcagaaggggcttctccaggggccactactgatgtctgcaaggaggccacaagctcttctgggccctgagacacacaggtgcctggggatggcagctgggtgcttggcaaggggcactgcactctttctccagggctaagaggagacatgactggggcacccactgctgcatgtaggtctccctcaggaactgccatttgggggactgaaaacacaaactttggtttatagaatttaggaaaagatacctgaccaagagaaacaggaatcatggaattcagtgggccagagtgactctcagcttgagatgttggaactccctctggaggctgcaggtcagtggagcactctgtcttgggaagaggaatatcagcctgagacccagaaggaatttccagagcaagctcaggggccaaggcagctctgggaacagtcacctggtattttgtaagtgtaacatcctcacagggagagagaatagaagattcaaagtgaggaccagtgagatcaagccgggatgatggaaacccagcaaaacccaccttaggcatctgcatggatggctctgaacaagccgaaacctgttgtaattcaaaacttgagcattctgaagatgataaaggaatcgtggaaagacctatgctagactttgcacctgggactaaactatctttaggagttttggtagaagaaaatgaaactttgggcactttaaaatgcagtttcttaaacttcgaatccattccaacttctccaacagcaagccccaagttaccatcgcgagatggatcatgaagatcaccttcatgaacaacagattccacaatgggaaatgtggaagtcttctcatggaatgtaacatttccttcgatttcagaggaagacatggaaactttctttgacgaccattcaaaaccagacgtgctcagttttggtccttgaaacttactgtctttcccagctacatcctcgtgggccagggacaggtccccctcaagccgcgcaccatccagcatggatcctggggcctggacatccgtctccacgctgggcagagacacctccacatcgggggccatcacctctgcctttgggcctttcaggtccagcttggggcccttgacgtccacctgggggcccttgaggtccactttgggcatcttgaaactgggcatctccaccttgggcaggtgccctttgaggccggctacctcgggcatgtggccttctggaagtttcaagtccacctggccagcctggacctccaggtcggcggaaggggcctgaatgcggaggtcagtggtcttgaggtccccctgcatggagggaatgctcatgtcggcctccatctttggcgcagacacatccaccgagacctcgatggacttgcctggggacaacatcccaaaggatggcatcttgaacttgggcattttgaacttgctgtctttggcagtcacgtccttgtcagccagggacaggtccccctccagccgcgtactgtccagcttggctcctggggcttggatgtccacctccatgctgggcagagacacgtccaggttgggggacgtcacctccaccttggggcctttcaggtccagcttggggacattaacgtctatctggggacccttgaggtccactttgggtaccttgaaactgggcatctgcagcttcggcaggtgccctttgaggccggctccctcatgcacagggccctctgggagtttcacatcctcttggccagcctggacctccagatcagcggaagggggctgaatgctgaggtgagtggtcttcaggtccccctgcatggaggggaggctcacgtcagcctccaccttcagcgcagacacatccaacgaggcctcgatggacttgcctggggcagacaccccgaacgacggcatcttgaacttgggcattttgaacttgctgtctttggcagtcatgtccttgtcggctagggacaggtcaccctccagccgcacactgtccagcttggctcccggggcctcgacgtccacctccatgctgggcagagacacctccacgacgggggtcatcacatccgccttggggcctttcaggtccagcttggggcccttgacatccacctgggggcccttgagggccactttgggcatcttcaaacagggcatctgcaccttggggaggtgccctttgaggccggctcccttgggcagggggccctccgggagtttcacgtccacttggccagcctggacctccaggtcggcggaaggggactgaatgctgaggtcagtggtcttgaggtccccctgcatggaggggaggctcacgtcggctttcgccttcagctcagacacatccacggacgcctccatggacttgcctggggccgacaccccgaatgatggcatcttgaacttgggcattttgaacttgctgtctttggcagtcacatccttgtcggccagggacaggtccccctccagctgcacaccatccagctttgctctcggggcctggacgtccacctccatgctggacagagacatcttcacatcaggggctgtcacttccgccttggggcctttcaggtccagcttggggcccttaacatctatctgggggcccttgaggtccactttgggcatcttgaaactgggcatctgcaccttgggcaggtgccctttgaggctggctccctcgggcacggggccctctgggagtttcacgtccacttggccagcctggacctccaggtcagcggaagggggctgaacgctgaggtcagtggccttgaggtccccctgcatggaagggaggctcacgtcggcctccacctttggcgcggtcacatccactgatgcctccatggacttgcctggggcagacaccccgaacgacggcatcttgaacttgggcattttgaacttgctgtctttggccgtcatgtccttgtcggccagggacaggtccccctccagccgcgcaccatccagcttggctcctggggcctcgacgtccacctccacgctgggcagagaaacctccacatcaggggctgtcacttccaccttggggtcttttaggtccagcttggggcccttgatgtctatttcagggcccttgaggtcgactttgggcatcttgaaactgggcatctgcaccttgggcaggtgtcctttgaggccggcttcctcgggcacgtggccctccaggagtttcatgtccacctggcgagcttggaccgtcaggtcggcagaatggggctgaatgctgaggtcagtggtcttgaggtccccctgcatggaggggagactcacatcggcctccaccttgggtgcagacacgtgcaccgaggcctcaatggacttgcctggggcagacaccccaaatgacggcatcttgaacttgggcattttgaatttgctgtctttggcagtcacatccttgtcggccagggacaggtccccctccagctgtgcactatccagtttggctcttggggcctggacgtccacctccacgctgggcagagacacctccacatcaggggctgtgacttccgccttggagacttttaggtccagcttggggcccttgatgtccacctgggggcccttgaggtccactttgggcatcttcaaactgggcatctccaccttgggcaggtgctctttgaggccggctccctcgggcacctggccctccgggagcttcacatccatctggccagcctggaccttcaggtcggcagaagggggctgaatgctgaggtcagtggtcttcaggtccccctgcatggaggggagactcacatcggcttccaccttgggtgcagacacatccaccgaggcctccatggacttccctggggccgataccctgaatgacggcatcttgaatttgggcattttgaacttgctgtctttggcagtcacgtccttgtcagccagggacaggtctccctccagccgcccagcatccagcttggccttcggggcctggacatccacctccacgctgggcagagacacctcgacatcggggactctcacttctgccttggggcctttcaggtccagcttggggcccttaacatctatctgggggcccttgaggtccactttgggcgtctttaaactgggcatctccactttgggcaggtgccctttgaggccggctccctcgggcacggggccctccaggagttccacatccacttggacagcctggacctccaggtcagcggaagggggctgaatgctgaggtcagtggccttgaggtccccctgcatggaggagaggctcacgtcggcctccaccttcggcgcagacacatccagcgaggcctcgatggacctgcctggggccgacaccccgaaggagggcatcttgaacttgggcattttgaacttgctgtctttggcagtcacatccttttcagccagggacaggtccccctccagccgcgcaccatccagcttggctctcggggcctggacgtccacctccacgctgggcagagacacctccacatcagggactgtcacttccgccttggggacttttaggtccagcttggggcccttgatgtccacctgggggctcttgaggtccactttgggcatcttgaaactgggcatctccaccttgggcaggtgccctttgaggccagctccctcgggcacgtggccctccgggagcttcacgtccacctggccagcctggacctccaggtccacagaagggagctgaatgctgaggtcagtggtcttgaggtccccctgcatggaggggaggctcacgtcggcctccgccttcggcgcagacacatccaccgaggcctggatggacttgcctggggcagacgccctgtacgacggcatcttgaatttgggcattttgaacttgctgtctttggcagtcacatccttgtcggccagggacaggtccccctccagccgtgcaccatccaacttggctcctggggcctcgacgtccacctccatgctgggctgagacacctccacgtcgggggccgtcacatccatcttcgggcctttcaggtccagcttggggcccttgatgtctatctgggggcccttgcgatctactttgggcatcttgaaactgggcatctgcaacttgggcaggtgccctttgaggccagctccctcgagaacgtggccctctgggagcttcacgtccacctggccagcctggacctccagttgggcagaggggggctcaatgctgatgtcagtgttcttcaggtccccctgcatggaggggaggctcaggtcggcctccacctttggcgcagacacatccaccaagacctcaatggacttgcctggggcagacaccccgaacgacggcatcttgaacttgggcattttgaacttgctgtctttggcagtcacatccttgtcggccagggacaggtccccctccagccgtgcaccatccaacttggctcctggggcctcgacatccacctccatgccgggctgagacacctccacgtcgggggccgtcacgtccgtcttcgggcctttcaggtccagcttggggcccttgacatctatctggggtcccttgcgatctactttgggcatcttgaaactgggcatctgcaacttgggcaggtgccctttgaggccagctccctcgggaacgtggccctctgggagcttcaggtccacctggccagcctggacctccagttgggcagaggggggctcaatgctgatgtcagtggtcttcaggtccccctgcatggaggggaggctcacttcggcctccaccttcggcgcagacacatccaccgagacctcaatggacttgcctggggcagacaccccgaacgacggcatcttgaacttgggcattttgaacttgctgtctttggcagtcacatccttgtcggccagggacaggtcaccctccagccgtgcaccatccagctttgctctcggggcctcgacgtccacctccacgctgggcagagacacctccacgtcgggggccgtcacctccgccttggggcctttcaggtccagcttggggcccttgacgtctatctgggggcccttgagatccactttgggcatcttgaaactgggcatctgcaccttgggcaggtgccctttgaggccggctccctcgggaacgtggccctctgggagtttcacgtccacctggccagcctggacctccagttgggcggaggggggctgaatgcggatgtcagtggtcttaagatccccttgcatggaggggaagctcccgtcagcttccaccttcagctcagacacatccaccgaggcctcgatggacttgcctggggccgacaccccgaatgacggcatcttgaacttgggcattttgaacttgctgtctttggctgtcatgcccttgtcggccagggacaggtccccctccagccgcgcaccatccagctttgctctcggggcctggacgtccacctccatgctggacagagacatcttcacatcgggggctgtcacttccgccttggggcctttcaggtccacgttggggcccttaacatctatctgggggcccttgaggtccacttcaggcatcttgaaactgggcatctgcagcttgggcaggtgccctttgaggccggctccctcgggaacgtggccctctgggagtttcacatccacctggccagcctggacctccagttgggcagaggggggctgaatgctgatgtcagtggtcttaaggtccccttgcatggaggggaggctcatgtcggcttccaccttcagctcagacacatccaccaacgcctcgatggactcgcctggggccgacaccctgaatgatggcatcttgaacttgggcattttgaacttgctatctttggctgtcacacccttgtcggccagggacaggtccccctccagccgcgcaccatccagctttgctctcggggcctggacgtccacctccatgctggacagagacatctccacatcgggggctgtcacttccgccttggggcctttcaggtccagcttggggcccttgacatctagctgggggcccttgaggtccatttcaggcatcttgaaactgggcatctgcaccttgggcaggtgccctttgaggccggctccctccggcacagggccctctgggagtttcacgtccacttggccagcctggacctccaggtcagcggaagggggctgaatgctgaggtcagtggccttgaggtccccctgcatggaggagaggctcccgtcggcctccaccttcggcgcagacacatccaccgaggcctcgatggacttgcctggggcagacaccccgaatgacggcatcttgaacttgggaattttgaacctgctgtctttggtagtcacatccttgtccgccacagacaggtccccctccagccacgcaccatccagcttggctcccggggcctcgacatccacctccacgctgggctgagacacctccacgtcgggggccatcacgtccgtcttggggcctttcaggtccagcttggggcccttgacatctatctgggggcccttgagatctactttgggcatcttgaaactgggcatctgcagcttgggcaggtgccctttgaggccggctccctccggcacggggccctctgggagtttcacatccacttggccagcctggacctccaggtcagcggaagggggctgaacgctgaggtcagtggtcttgaggtccccctgcatggaggggaggctcacgtcggcctccaccttcaacgcagacacatccgctgaggcctcgatggacttgccaagggcagacaccccaaacgacagcatcttgaacttgggcattttgaacttgctgtctttggcagtcacgtccttgtcggccagggacatgtccccctccagccgcgcaccatccagcttggctcctggggccttgacgtccacctccacgctgggcagagacacctccacatcaggggctgtcacttccaccttggggtcttttaggtccagcttggggcccttgatgtctatttcggggcccttgaggtccactttgggcaccttgaaactgggcatctgcagcttgggcaggtgccctttgaggccgacttcctcgggcacagggccctccaggagtttcacgtccacctggccagcctggaccttcacgtcggcggaaaggggctgaatgctgaggtcagtggtcttgaggtccccctgcatggaggggagactcatgtcggcctccaccttgggtggagacacatccaccgaggcctcgatggacttgcctggggcagacaccccaaacgacggcatcttgaacttgggcattttgaacttgctgtctttggtagtcaggtccttgttggccagggtcaggtccccctgcagatgcgcactatccagcttggctcttggggcctggacgtccacctccatgctgggcagagacacctcgacatcggggactctcatttccaccttggggtcttttaggtccagtttggggcccttgatgtccacctgggggcccttgaggtccactttgggcatcttcaaactgggcatctccaccttgggcaggtgccctttgaggccagctccctcgggcacgtggccctccgggagcttcacatccacctggccagtctggaccttcaggtcggcagaagggggctgaatgctgaggtcagtggtcttcaggtccccctgcatggaggggagactcacgtcggcctccaccttgggtgcaggcacatccaccgaggcctcgatggacctccctggggccgataccccgaacgacggcatcttgaatttgggcattttgaacttgctgtctttggcagtcatgtccttgtcggccagggacaggtctccctccagccgcgcaccatccagcttagccttctgggcctggacatccacctccatgctgggcagagacacctcgacatcgggggctgtcacttccgccttggggcctttcaggtccagcttggcgcccttaacatctgtctgggggcccttgaggtccactttgggcatcttgaaactgggcatatccaccttgggcaagtgccctttgaggccggctccctcgggcacctggccctccgggagcttcatgtccacttggccagcctggaccaccaggtctgcagaagggagcggaatgcagaggtccgtggtcttgaggtccccctgcatggaggggaggctcacttcggcctccaccttcggcgcagacacatccaccgaggcctcgatggacttgcctggggcagacaccccgaacgacggcatcttgaacttgggcattttgaacttgctgtctttggcagtcacatccttgtcggccagggacaggtcaccctccagccgcacactgtccagcttggctcctggagcctcgacgtccacctccacgctgggcagagacacctccacgtcgggggccatcacctccgccttggggcctttcaggtccagcttggggcccttgacgtccatctgggggcccttgagggccactttgggcatcttcaaactgggcatctgcaccttggggaggtgccctttgaagccggctccctcgggaagggggccctccgggagtttcacgttcacttggccagcctggacctccaggtcggcggaaggggactgaatgctgaggtcagtggtcttcaggtccccctgcatggaggggaggctcacatcagcttccaccttcggctcagacacatccaccgaggcctcgatggacttgcctggggccgacaccccaaatgatggcatcttgaacttgggcattttgaacttgctgtctttggcagtcaccgccttgtcggccagggacaggtccccctccagctgcgcaccatccagctttgctctcggggcctggacgtccacctccatgctggacagagacatcttcacatcgggggctgtcacttccaccttggggcctttcaggtccagcttggggcccttaacatctatctggggccccttgaggtccactttgggcatcttgaaactgggcatctgcactttgggcaggtgccctttgaggccggctccctcggacacagggccctctgggagtttcacgtccacttggccagcctggacctccaggtcagcagaagggggctgtatgctcaggtcagtggccttgaggtccccctgcatggaggggaggctcacgtcggcctccaccttcggcgcagacacatccactgaggcctcgatggacttgcctggggcagacaccccgaacgacggcatcttgaacttgggcattttgaacttgctgtctttggtagtcaagtccttgtcggccagggacatgtcctcctccagccgtccaccatccagcttggctcctggggcctcgacatccacctccacgctgggcagagaaacctccacatcaggggctgtcacttccaccttggggtcttttaggtccagcttggggcccttgatgtctatttcagggcccttgaggtccactttgggcaccttgaaactgggcatctgcagcttgggcaggtgccctttgaggccggctccctcgggcacggggccctctgggagtttcacgtccaattggccagcctggagctccaggtcagtggaagggggctgaatgctgaggtcagtggtcttgaggtccccctgcatggaggggaggctcatgtcggcctccaccttgggtgcagacaggtccacggaggcctcaatggacttgcctggggcagacaccccgaacgacggcatcttgaacttgggcattttgaacttgctgtctttggcagtcacgtccttgtcagccagggacaggtccccgtccagctgtgcgccatccaacttggctcccggggcctgcatgtccacctccacactgggcagagacacagccacttcgtgggccgtcacctctgccttatgacctttcaggtccagcttggggcccctgacttccacctgggggcccttgaggtccactttgggcatcttcaaactaggcatctgcaccttgggcaggtgccctttgaagccggctccctcaggcacgtggccctccaggagcttcacgtccacctggccagcgtggacctccaggtcagcggaagggggctgaatgctgaggtcagtggtcttgaggtccccctgcatggaggggagactcacgtcggcctccactttgggtgcagacacatccaccgaggcctcgatggacttgcctggggctgacgccccgaacgatggcatcttgaacttgggcattttgaacctgctgtctttggcagtcacatccttgtcggccagggacagttccccctccagccgcgcactgtccagcttggctcccggggcctcgacgtccacctccacgctgggcagagacacctccacatcaggggctgtgacttccgccttggggcttttcaggtccagcttggggcccttgacgtccacctgggggcccttgagggccactttgggcatcttgaaactgggcatctccaccttgggcaagtgccctttaaggccagctccctcgggcaggtggccctccgggagcttcacatccacctggtcagcctggaccttcaggtcagtagaagcaggctgaatgctgaggtcagtggtcttcaggtccccctgcatggaggggagactcaggtcggcctccaccttgggtgcagacacatccaccaaggccttgatggacttccctggggccgataccccgaacgacggcatcttgaacttgggcattttgaacttgctgtctttggcagtcacgtccttgtcggccagggacaggtccccctccagccacgcaccatccagcttggccttctgggcctggacatccacctccatgctgggcagagacacctcgccatcgggggctgtcacttccgccttggggcctttcaggtccagcttggggcccttaacatctatctgggggcccttgaggtccactttgggcatcttgaaactgggcatctccactttgggcaggtgcactttggggccggctccctcgggcacagggccctccggaagtttcacatccacttggccagcctggacctccaggtcagcggaagggggctgaatgctgaggtcagtggccttgaggtccccctgcatggaggagaggctcacgtcggcctccaccttcggcgcagacacatccaccgagtcctccatggacttgcctggggccgacaccccgaatgatggcatcttgaacttgggcattttgaacttgctgtctttggcagtcacctccttgtcggccagggacaggtccccctccagccgcgcaccatccagctttgctctcggggcctggacgtccacctccatgctggacagagacatcttcacatcgggggctgtcacttccgccttggggcctttcaggtccagcttggggcccttgaggtccactttgggcatcttcaaactgggcctctgcaccttgggcaggtgccctttgaggctggctccctcgggcagggggccctccggaagtttcacatccacttggccatcctggacctccaggtcagcggaaggggtctggacgctgaggtcagtggtcttgaggtccccctgcatggagaggaggctcacgtcggcctccaccttcggcgcagacacatccaccgaggcctccatggacttgcctggggctgacgccccgaacaatggcatcttgaacttgggcattttgaacttgctgtctttggtggccacttccttttctgtcagaatttgttccttttttaagcgtttttcatcgtgtattagttgtatttttgttgtgtttgtcattgagtcactgtcttctttgtcttttaatccttcctctgtgcgtctctgttctcttctatcagctgttgctgtggcctctccttcccttccctgctctgtgtcttctgtggctttttctctgcctgtctttgtgtgcttgcttggcgaccatcctaaggagggtatcttgaacttgggcattcttatctgtccttctgtgtcttccctgcccttgtcctgttcctcagtgatccttgtcctctgtagtccttcctctccatctccttcatccccctgtgcttctgcatgtgtggttggttccctgcccggcatccacccggctccttccacctcctcacccttcaggccagtacccgcttttgaggacgcatcctgtctcttccctcgctgtggggtactaaggcgcctttctctttctggctctttttctgtggaaaatgcaaattttggtgtctttaaatcgtgtactcgcaccctaatttctggtgggccaatctgtgtgcctccttcggttgtgtctctcaaggacagtctggcgatcccgatttccaggctctgcagtccctcgccttcaccctcccggctcattccaggagttggctgggccctgggcttcctctgggccactgctgtctcctgtgcctgcccctccagggtctttccatggagcctggctgccctgagtcccccttcctgaggggttccctcgcaaagtctagggtcaccgagctctgtgggcaatggcatgctctgagcaggcatcacttctcgatcctgttctgccctctcctctctcctgctgcctgtggcagccccagtctcctcgaggctatcaccccagggccccaactcttccaggaccccagcacggcccaccccactctggaaccccctgcctggctgtcctgtcgatgaagggccctgtcccgagcctgtcctgaatctgaggttgaggaacttccgcctcctctggctgcccggccctgccttctgctcttggcgctccaccgtgagctgggcctctgtgtctgtgcttgtaggggacacgtcatgtgcgtccctaggttcgtaggcctctgacgagctgtgtgacctctggggtcccggcccccgcttgctctttatggattgaaattttggccaagagagcctctccctctggctctgcctgcctctccccacccttggtttggagatgagtctctcttggtccccatctccttccagagttttcgtgggggtctctctgcacccatcagcaacatccgtgtcctgaaacatagggagagggaatctgttggtgccagtccaagaagcctggggccctggcccagggacagatggagtgggagtgctatcccctcccaggctcagccagcagggtagtgaagccagctggggccctgccccccgggcatagtggtctcacctccttctccttgccctgtgggccgtgctgggcatcgctggaagcccactcttcatcctgtggggcagggagctgccgtctgattttgaactgaaccttgtacggctctgaatattgaaggattttgagagcatcttcatattttatgttttcaaagaacacggttgtactgagcagctgatcccctagaccaagaaagagcagccccagggccgggtgtgtgaatgagacggggtctgctgtcttgccttggctggcgaggagggtcccggggacatgaatagggggaatcccactgagtctgccccaccagtcccccactgagtgcctcaggcacaggcaaggtggatggggtcccccattttactagatgcagtgggtgatcccagcctcaagctgttgagcagaggcgtgaggaggtcatcctaagctccaggtgtggttcttacccctcaatacccccctccaggtccctcccatcctggtggggagaatggtgaccccagggatggaactgccatggcaccttctctcaagttaaaaagcttggcggctgaggagtccttcagcacttgcttgacgaagatcccctggtccccaccacctgtgacactgtagccactggctcctgcctccacctctgtcttcagcgtcacctctgttgcctcctggacagcctggagcagaagcacatcagggccatggtgagcatgtgccagtcccaccataagcatccctgctggggcctgtgtctccagaggatgggcaccccaccatcctttccatcagcccagacaacacagagcagagtagggtacccaccaggtgggctcaggtagctgtctctgagctctggaggaagccagctggaacctgccagaactcttgtccccaccccaacctgccaggacttaggcacagcctgtccatgccaccaggcccagcagggcaccaggagcagcgcagaacggattctgctttccctgtggccagtttctctttttcagctccttcatgcattcttcacaaacgcgtgaagcaccagttgtgtgcaaggcacctgatgctcaagacaaggaagcacagcaatgccaaggaaaatacgggacattgggtgcagcctgcgagacctgggacaggatggggcctgtgtcctgcagagctcttggactgctggggcctccaaggaaaaaaactagttgcttaagaggcagagtgccctcatcattgggtgctagcagagtctagcaccttccatagttccatggcctgggtgctgactggccttttcagccccacagcttgaatatgcaacagacaccagcactgccccattgcacggaggagaaaatcgaggtctgtacagccaggtctacctggccaggagcttggctatgcatcagactccaccccagggaggggtggagagggccaggaccagatgtagccttctggagcccctgcccttccccaggcctgacaagggggacaagaacacccctcctccccagggcacggggcacactgccagcctctttgctcctcccctgcctgctctgacctcggactctctggctggatcccttgaggaccgacacacctctgtgaccctcagctcctgctgtacccacctctggacgactcatcctgaaaaatgtccgtgagtcccctgaatctcgcttccaccaggatctccgtctcccagcagaaccttgcctgccgggggcgtcttcctgcagccacaagtgttgggagttaggcacctgccccagctcagggacagggaggggcacaggtaggctggtgccagaccaggagccctcccttcagaggggcccagaacttccaacacacagctgtgtgcagaggcagccgagttcctccaggcacatccacagagaaaaggcaactctcggccttcctgcttcccgacagggcccagcctacagcccacagcacccaccctacagcccacagcgcccatagggaagccccacagcaactggagttttgtatggagggagataagaaattcaaattgtacaaaaatgaatcctttcatagacatgcctcctctgatcccttccccgagtccttgtctccagaggtagccatggggccctgtccccaaagacagcatgagtgtgttacacaggtgcagggatgcacacaccctgtgcccctgaaacacaaacacagtaacatgaggcctgtccccatcagcccatacgcatgctcacaagagctgcagggcacctccatcccactgtgccctggccggccacagggagggacccaagggcacagaggagtctgagaggacatctgagtgggcactgcccagtgggcagcggggcagggcagcaaggttgaacagacatgcgtgagttgcccacacagggcgatgcaggaggagacctgggtgcctgtggggctctgcccagcaggctcacctggagtccaaagtcggcagcctcagtcgtgtattcgtagacaggtgaagacccctgcggccgtggtcgaatgccctcatccgcaggcccttcagtcacctgacgggagagaatccagttatttttgccactcggttctcccagggcccagggagaatgggggcagggtatgaggaggacacacttcctcctgctctcacttacagagtggtcatcttccgtttctgcacctggctccccgggctgcagctgacggccggacactgcagagagagtggctgtcagtggagacaagcaggctgggggagcagatcggggcccgggggagggagccaggactgtatgtacactgtggaggtgtcatagtcctttcctggacactggatcggagagcaaactcaggggctgggggaagatctatagccaatgggctggagaggctgaggcatcacgtcaggtagcagtgaattgagactggacttattccaagttggaacagatttagtccaagaaagtgactaaacaaacacaaggcgtttgttattgtataaccacaccctgggaggatcagaatccagagctgccagaatatattatctaaaatgtccagcagccaccaaaaaattacaagttacgcgaagaaacaagaatgtatggtccatactgagaaacaaagcagtgaatggaaagtgtctctaaatgtctactaatgctgggtttaatacagacttcaaagaaactattaaaagtttgttcaggccgggcacggtggctcatgcctgtaatcccaggactttgggaggctgaggcgggtggatcacctgaggttgggagttcgagaccagcctcaccaacatggagaaaccccatctctactaaaaatacaaaattagccaggcatggtggcacatgcctgtaatcccagctactcaggaggctgaggtaggagaatcacttgaacctgggaggcggaggttgtggtgagccgagattgtgccattgtactccagcctgggcaacaagagtgaaactccgtctcaaaaagaaaaaaaaaagtttgttcaaaacacaaaaacaaatcatgtttaaaaaattaatggaaaatatgttaacaatggctcaatgaagagagaatctcataaagaaataaaacttattttttaaaagcaagcaaaaattctggagttgaaaatttactactggggttcaccaacagatttgagataccagaagaattatcaacttgtagattaatataaattaaccaatttgaagaacggggtcagggggaagattgtttgaagaaaaacagagtctcagagcattaaccataagataaagaggcagaagagagagttgaagaagtgatagctgaaaacaatctgcagaatccaagaagcgcgaccagacctaagcaggagaaacacagagatccacacctagaaacgtcacagtcaaaatgcttaagagaaagggccccatcacataataagggcacaaaaatacaactaacacctgaatcacatcaaaaccatagaagctacgagaaagtggaacaatatattcaaagggctgaaagaaactgttgtcaacgaagaatttgatatcaagcaacctatccttccaaaaataaaggcaaaatagtctgggcatgctggcttatgcctgtaatcccagcactttgggaggctgaagtgcgaggattgcttgagcccagaaactcaaggccagcctgagcaatatagtaagatctcatctctacaaaaaaaaattttttttttgagacggagtctcactctgtcacccaggatgaagtgcagtggcacgatcttggttcactgcaacctccgcctcccaggttcaagtgattcttctgcctcagcctcccgagtagctgggactacagacacgcgctaccatgcccagctaattttcgtacgtttaggagagacgggtttcaccatgtcggccaggctggtcttgaactcttgacctcgtgatccgcctgcctcagcctcccaaagtgctgggattacaggcatgagctgccgtgtccggcccaaaaatttttttaaaaattagcggggcatggtggtgcatgcctatagtcccagctgctcaggaggctgaggcgggaggatagcttaagcctgagaggttgaggctgcagtgagctgtgattgcaccacttcactctagtcaggcagagcaagactctgtctcaaaaaaataaaaatttaaattttaaaaaaaggaaaaataaaggcattcccaaatgaacaaagacttggaaatgtcattgctagcaaatctgccttacaagatatactaaagaagtccttcggactgaaaggaactaataccagacactaagtcaaatgcacaggaagaaatggagaatgcagaaaatggtaactatgcaggcaaatataaaagactctatgaatatatattgtcctcattttatttcttaacttctttcaaaaacagaggattgtataaagcaaggattgacaaacttttcttgaaaaaggcaatatagtggatattttaagcttaccaggccacatgatctctgttgcaactctgcagccatagtacaaaagcagctatagattatagataatatgtaaataaatgagcaaaactgtttcaacaaaactttacttgtaaaacaaaaaggaggctggatttagaagacagacaatcatctgtgaaccacttatataaggcaacaattctaacaccatattgttaggattataacatatatagatacagtatatacgtgacaataatagcaaaaaggagtaggaggagagggtatacagtcagcctctcatatcagtggtttctgtatcctgagttcaatgaaacttgggtcaaaaatgttctcccaaaaattgcacctgtactgaacacgtgtagactttttttcttgtcattattccctaaacaatatagtataccagctatttacatagcatttacattgcattaggtattataagtaatctagagatgatttaaagtataggggagggaagatgtatgtaggttatttgcaaatactacattgctttatagaagggacttgagcatccatgaattttggtatctgagggaggtcctagaagcaatccctcatggatgctgaggcacaagtgtaccctggaccaaagtttctataatttaccagaattaagctggcattgcctggggctgggagtgggaagggagattgattgtaaatggggttgagaaaatttggaaggtgatggaggtcttccagaactggattgtggtaatgtttgcacaactctataaggttagtaaaatgattgaattgtacatttacaatgggtgagttctatggtttataaactgtacctcaatgaaactgtaaaagaaaaaggtaattaactgtataaaacaaaaataagtcagcacggtggctcacacctgtaatcccagcactttgggaggccaaggagggcagatcacttgaggccaggagtttgagaccagcctggccaacatggtgaaacccctctctactaaaaatacaaacattagctgggcagggtggtgcacgtctgtaatcccagctactcaagaagcagaggcaggagaatcacttgaacccaggaggtggaggttgcagtgagctgagattgttccactgcactccagccttggtaacagaccaagactctgtctccaaaaaaaaaaacaaataaaataaaatgtatcttagaattttacaaatatagaagtaaagcatatgacaggatggggatggagtgcaaaagttgctgttgtgggccgggcacggtggctcacgcctgtaatcccagcactttgggaggccgaggcgggcggatcacgaggtcaggagatcaaaaccatcctggctaacacagtgaaaccccgtctctactaaaaatacaaaaaaatagccgggcgaggtggcgggcgcctgtagtcccagctactcgggaggctgaggcaggagaatggcgtgaaccccggggggcggagcctgcagtgagccgagatcgcgtcactgcactccagcctgggtgacagcgagaccccatcttaaaaaaaaaaaaaaagttgctgttgtgaagatcttacattatacttaaagtaggacaatcttacttgaaattatactgtaataagttaaatattcagggtataaagcataatgcaaccattaaaaaaataaaaagatgtataggtaataagccaatagtggaaccaaaatggaatgctaggctgggcacagtggcttgtgccgtaatcccagcactttaggagaccgaggcaggaggaacacttgaggccaggagtttgagactagcctgggcaacacagtgagacctcatctttagaaaatatttaaaaattagccatgcatggtggcgcacatctgtattcccagctactcgggaggctgaggtgggaggatcacttgagcccaggaggttaaagctgcagtgagccaagctcatgccactgcactccagccggggcagcaaagcaagaccctgtctcaaaaaacaaacaaaccaaaaaacacctagatctcctttttgaaacactgcagtaaaaactggcaaaactgaaaggagaaataaatccacaattattatacaataggagattctaacactcttaggaaatgataaccttacaaagtagaataggggaagatacaaaacacttgaagtacccatcaaccaacgagaccaaactggcactgggagaacactcctgacagcagccggtgcatgctgctctcaggtgcacaggggacagtcactgagacaggccccatgctggctcagaaacctgtcttgacgaatttaaaataacttcagtcatccgagttctcttctctgacccccagtggaatcaagacagtgcggcagaaacacaaatcagtgaacagaaaacaaagtccagaacagccccacacttacatggccaattcattcttgtttgttggttggttggttttgttttgagacagggtctcactctgtcgctcaggctggaatgcagtggcacaatctcagctcacagcaacttctgcctcctgggttcaagcgtttctggtgcctcatcctcccaagtagctgggattacaggcatgcgccatcatgcctcactaattttttttttttttggtacttttagtagagatggggtttcaccatgttgcccaggctggtcttgaactcctggcctcaagtgatccacctgccttggcctcccaaagtacaggcgtgagccaccatgcccggccaaattcttgtcaaagcagcccagttattccaacagaaagcaaagtcttttcaccgaatggtcctggaacagctgggtatttactgggaaaccaataaacctggacccttccatcccatcactcatgaaaatgaatttgaaatgaatcatagaggggaatgtaaaaccaaaaactataaaacttctagaagaaaatataggagaacttctttaacacctcgagggcagcaaagttttcttaggatacagaaggtaaggatcatagaacgaaaactgataaatttaagttctcataatttaaaacactggccttaagagctttcattttcctcagaaaacgaaaaggcagtgaatgtatctggcaaaggacttgcatggagcctgtgtacaactcaacggaagagaaaaagctcagctaaaaataggcagcagatttgaacagacatttcacaaaagaagatgtacgagtgttcaataagtacaaggaaagatgctcaacattttcagtcatcaggaaaatgcaaatcaagaccaatggaacagaacagagatcccagaaacagacacacgtacacaaagctgtgatgatctgttcaacacatggcctgggatccatgggatatccatatggaaaaacattaatcttcgccccacctcagccagagaaaattaatttcatgtggattacagatccaaaattaaaggcttaacaataaaatttctagaaaataaatagaaattacttttggagtaggggaaaaattcttaaacagaacacacaaaaaatgacagatattggtctatattaaaattaagagcttctggccaggcgcggtggctcacgcctgtaatcccaacactttgggaggccgaggcgggcggatcacgaggtcaggagatcgagaccatcctggctaacacggtgaaaccctgtctcttctaaaaatacaaaaaattagccgggtgtggtggcgggtgcctgtagtcccagctactcgggaggctgaggcaggagaatggcgtgaacccgggaggcggagcttgcagtgagctgagattgcgccactgcactccagcctgggccacacagcgagactccgtctaaaaaaaaaaaagaaaaaaaaaagagagagagagaaaagaattaagagcttctgttcatcaaaaaacaccactaagggcatgaaatgtaaattagtatagccatgatagaaaacactatggatggttcctcaaaaaattaaaaatagaactaccatttgatccagcagtcccactactgggtatatatccaaaggaaatgaaatcgataaattgcagctatctttgcccaaaacacagattgggcaaagatacctgcaatacatttaccaagcaaaggcctccaacccagaatgcacaaagaattcttgcaaaccaaaagacaaacaacccgatagaaatatgggcaagaaaacactggaaaggtagctcatagaagaggatattcaaccagccgattagtatatggaaagatggccagcatttctagtcatctgggcaatgctaacaaaaccacgaggtgccatatgctcccaggagaatggctgaaatggaaaagtcgaggcagaccacctggagacaaggcctagggcagctggaactccatcctggtgtgggttgggggtcagctggcgcaaccacttggaaacagcctggtagagccttaccctgtggcccagcaactcatagccaggggcagagccaagaaatatgcgcacatatgtccctcaaaagatggatgcaggaacatccatctcagtataatctgcagcacccagaaaccagagattcaaatgtccatcaacagtagaataaaaaaaaatgcgaggtatttgtccaatggaacagtatatggtataaactatgcctatgtgcaacgtggatgaagttcacaaacacaaggttgagacacagaagctagatataaaaagcgctcgtaccgggggagcccgtcacatccagctcacagtcaggctcaggccacctagggctgaagtcaccagggggagcaggcagacagggtctcctggagaggactaattacttgggtgtgccatggtttgtaccctttctccataaaaaattttagaattctatataaaatcaaacacaattataaactttacactaataaatctgaaaatttcgattgattggatatattcctagaaaacccacaagaagaaccaaacttgtccaacccacggcccacaggccgcatgtggcccagaacagctttgaatacggcttaacacaaattcataaacttcctaaaactttattacactcttttgcaattgtttcttttagctcatcagctatcattagtgtagtttatgtgtgacccaagacaattcttcttcttccaatgtagcccagggaagccaaaagataggacggacgccccgatggataatccaagtatttttgtaacgatttaaaaatcaacatggtgaaaccccatctctactaaaaatacaaaaattagctgggcatggtggcaggcgcctgtaatcccagctactaggaagactgaggcaggagaatcacttgaacccagaaggcagaggttgcagtgagccaagatcatgccattgcactccagcctcagcaacaaaagcaaaactctgtctcaaaaaaaaaaaaaaaaaaaagaaaagaaaagaaaagaaaaaatcaaatcccttatttaaaaccgtcccacaaaaaggactccagtctcaaccccactctgaattatactctaaatattccaagaagaaacagtaccaatcttacgccaactctggcgccctggcctgggctccagggcctccctcctgcagtgacaaggagggtctcagaactaaggcccccatccctgccccagacccagttgctggtaggacactgattgggaaggagcatgtccctatcctttggggtggtgtgctggcctcggggaccagctgctccctgtcccctgcggtaggtgtcctggccttggggactgtcccacgaagacagatggggaggcccagtcccggcagtggtctaggtctggctgctcctctggccagtgtgctgtgtggccctgagcaagctcatcccctctctgagctttcattccctcatggatatgtggaccaccctgcctgccctgactgtgggttgctgggctacagacactgctcccgcagaggcacccccagggccatgcctgctcatcccaagagcacctctgcctgcgcgggcccctgccactccctcaccgcttcacgggcctttccttgcccttctgcaagatggctcacagcccaggtcccctctggctctgctctcaggcctggcagggctggaggatggtgtctcctggaggaggttctctcaagcgaaggaagagaagggcaggaggtgagggcaggcagggctgggtcagtgccaggaggcatcaacactcacccccacgtcatcccggccccgccaccttcctactgctccgggggccaggcccagacccctggcctccataaccccccagcagagccacaacctccgtttcccccacctgccaaaccagccttgcccacggtgtcagcccaagaattgtacccctggcaaccccacaacacgatctcctccacaggccccttctccctaaccaggcagtgaaggggcaagaccctgtctcccttctgcacagctctgtcctggccacctgggcccatctcactcacctttgcattcagacactgccccaccacctgacagggcccctgctgctcccacctggacgcacccccaacctgcacagacagaacttggccagccccaccgctctgcctcccagatggctgccaaaccctccactccttgcccacctgccccctcccactccctccacgtggccctgccagggctccccagtgcaccccacaaccctgagggaccaccagctggggccaccccagcccctctggagctgcctggagctccagccacaccagacccacaacaaattcgtgggacggggtggtgccaaggaaagggacaggaatctggccagagcctgcccaccgctaagccaagggcaatggcaggtaagccactctctggcctcagtttcccttcctgctctgcccagaccctgccgctcaatccccaaggtgggtaacatatgtgaaaactgaggctgggggaggggagccacttacccaaggggacccagccagtaggtgtggagctggggcaactacctagcagggctgggggcagaggagggtccctgggtcacttggcccacagctgctcccctggcagcaggtgcagctggggtcatgagtggggaggggctccactgcctcggagaccgggtgtcccaggccctgcctagcactcagggtggggcaggtgttctgaggctgcccagaaacccagccgcctccccgtccctccgcagcctccccagccaaaaagccccacccagctggcaggagcctggatgggttgggggtggggggcagctgctgtgaggcccaagaaagggtcaggagggcaactcctcggagaagggactcgccaggcagggaaacacaggtctgctgggctgggggtgggcaccacggtcaagggcccctgagctgggcacagccggctgcactcccaaatctctccagggtagtcttgtgggtgttggggccggtgagggagggtgtcgacagcaagccctgggcacaccctgtgctgggaacctgcatgggggaaggaggaggagacgtgaccagccctgctcctgctggccctcgtgcctggtcctgccactggcccacgcgggacagtccccagccccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccgcgccagtcgggagagagaggaaggcccccagtatcccagtcccccgccaagagcaccgcctcccaggcccgagctcctgaggaagccccgcctcggccgcagagcgcaggggaggccgcctttgcccgcccggcctccggttctcccagacaggctctgcaagtggccccatcacctgaatcatgacactgtttgttgacggtcaccaaagccccacttcacagaggagaatgtggaggtgactcgcctgagccaggcccagctggtcaggccgttggcacctggttccttccccaatgcccttcccccactccccgggccccccagcgccctggcctcaacactaccattaacattcctgcgggtgaaaacttgaaccttgtggagggaccccgggacccaggtcagtcccttgcatgccagggcaggtgggggtggtaccacagtgaaagccgcagaggacacccaccctggcccagaaaagctgcctccccgagaactggactatcctggcgcagggcctgagcaggcggggcctcaggcagtgtgtctgggggacgagcagatcctggccgggaggcggggaggggccgagcgggaggggagaaggaacacaggcggggagtgtggcagaggctcaccaacacccctgctccacagctgggtccagattgaggactcccaccagccaccagctaaatgagagttcttggagggtccagaacaggtccgtggggggaggaggtggattttgcttaaacaaaatccaagtttgcctctaaactggcagccccagggccccatctctggcctccaggtgggagggcatggttgggtgcatttgcaagtccccagggccctgggggctggcagggaggagactggctctccagtggccggaaaagtccatcctgggtgggaggaacgaatggcccactccaggtttgcaggtgtgtgtgcacacgtgtgtgctcacaggatgtacgtgctcaggtgctagggcgtgtgtgcacttgtgtgtctggcctgggctcctccctctgaacacccatggacagcccagagtgaggccatggaggcgggagccctgtgggagtcactgccctcgggctggaaacctggtgcccacccagacacaggcacacacagccggccgcacttgggcctcacccagtcgtggaacttcatgaagaaggtgccaagcgggctgactgtcatgagaccttcagacttccctgagcaacatcccccgcccctccccgatgcttcttgagataactctctcgggatgagctcaggctcttgctcctgcctctgtgtctgcctccaaggctgcaggagggctggggaagccagactcagtcccctagacctgggagctgggctccttgcccatccagcagccattccccactgcagcccagctgcacccgtgaggctattcacatcaccctctcccgaaacaacctttcgtagctccctggtgccatccatcggtcagactggcctggcagcctctccgtgcctgctctagccctagccgacatccccagcctctccagccctcactgtgcctgcctgggccacaggcgctctctctctgggctttcccaggctgtcttctctgctgggcaaattcacagactgagcttggccaccctgccatggcttctggacactgccggctccctggtccccagaacactttgctcaccaagcactcagagcctggcacacagtaggtgcataataaatgctagtgcaggcagtgcatgggaaaaaggaaggagcttgtcagatctcctggaaaagcctggtaagcctgagggtgggagccagttgatggggatgggagggcagcaggtgggcccagttcatctccttctgctcctggagaaactgaggcacagggtagcacatgtgccacctctccaagggatttggcagccaaaaggaacagccccatgctcccatccatcccaggcgggctagcctgagccagtttccctgggctgaaaggccggccccacagacgtccagggcagtgtgaccctgtgatggagctacccatcgccccaggcccccacagcccacctcgggcacccccaggagagtaaacctggcctttggaagcaaccaccctccacagccacccagggcccctgtgcaccaagcaagcacacggtcatctgaggacccttctccaggccccacgcccaccttggggacttgcagacctgcggctgccctgaatgtgggtgctcttggcattcacctccccccacacccaggctccttggaaacaagagccactgtcccctacctgcccagggcccacagcttggtgtcctgccacacaccttgtatggcctgggctccgccggcaccccagggaccaggacccaggagaaggggctccggggctttctccctgacatccctgcccagcccgctggccctggctggagccacggtgaactaacacccctgcccgtctgtcagctgcaggtcgggggatgcctagcccagctctgttcctccagccccccttgctggtggcctgctggcccccacagacccgcggaagagtgaggcaagcaggtgtccggacatggacacaggagccacttaccaaggaagctacagacgctctcccaactggcccagaagcgaagatcccaactggccacctccccctgccacgcccggttcttccctccacagctcctccccccattgtcccgcctctgcctgctcctagggctggctctggaccctgccaggacccccacatcccaccagagggagtgggcgggtcccctgatgggccaggagcctggccagcccccaacactcactcagcttcttggagctggggaccccaccctgagtgcccacccccagcctgagcagctgactgcagaggaacagaccgctctgagtcacacagccagcccagtctggtgagtgccttagtgtgcgccaggtcctgctgtgtggacagacacaggcctgaggcaggtccctcctaggcaggctctgcacaaaccctgtgtctcagtttccctatgggggccaggacagaggctggcccagaagggaggagaggcatagcctaagggcctgcccccatggtcactgggccagtgaccttggggcctggtcatctgccacctgcctgagcccccagggcagccgaccctggcctcccttcagcccgctcagcccaaactcacagcggccaccacacctcgaagcaccagggtatctggtaagcagggtgcggtggggctcaggaagcagcattttttgaaacagggtctctctctcacccaggttggagtgcagtggtgcgatcatggctcactgcagcctcaaactcctggactcaaaccatcctcccgtgtcagcctctcaagtggctggggctccaggtgacgccaccacacctggctaattttaaaaattttttgtagagataggatcctaccatattgtccaggctgatctcatacgcatgggctcaggtgatcctcccgccttggcctcccaagtggctggggctgcaggcacacaccagcacgcctggctaatttttaaattttttgtagagacaaggtctccctgtgttgccctggctagtctcaaactcctaggctcaagtgatccttctgcctcagcctcccaaactgctgggattacaggtgtgagcctccgcactggcctagcttttttttttaacaagcctcccatccttccccgtcatttcaatacaagtggtggctgagaaacacctgagtcccatgaccccaagtcccccactatccagagctccagctgcctggcccacctcctggtcacctcaccctgctgcaccctgggcccttagcccccactcctctttgctctgggcagccaggaggctccagcaggactcaaccagctgtgctacgtgtagcccccctgggatcccagtgtgccagccctgtgcccatagcctgggtgtggacgtgcctccaacaggcagtctggagcaggcccacacagccgaggcccagcccaggccttaggggcagcgaggggtcagacccagcctgggaggtcagcgatggaacggcttgcacctgcaccaggccccaacggcatgggaagaggtgggaaggtgcagctgagagggctgcccccgccacgggatgccagggtggcctgaggtgggcacacagagaaggggtcctcaagtaggccagaggacttcaagggcagggaaggctctgtcccagccccagggcaggggcacttgccggcaaatggggtgggagaggcctcaggggctcctcaggcctgaaaggtggggacctgattccaggccccttctgggcctccccccattgcaataccctaaaaaggctgacacaaaaacctaacggtcacaaagatagaaaacgactctatttacacggaggcaggaaagctggccacgtctgctccagggacactcccagacagctctcacctgggaacgctgtttactgtttaccacctgacacccacactcagccaggcagggcagggctggctgagtcagcgccgtacccagaggcccagcctgctggagtgggacaggaaggagacgctggcacagagcggggccgtcatgccagacacagcactgacccccgcaagagcctttgctggggcccccaccccagctacgcccacctcacagcagccagagggaggtgccctgcacagctggccacagcgctggccacgcaagcccttcccagaccctcgctgcagtgcggccagtgtggtccgccaagccctggaacacatgacggagatctcctcctggtgcaccctccccaacgcggacagccatgggaacgcaccacaccctgccccaggccctctccagactctaagcacgtgccactggctctgcctggggcaccctcccagctcagatcctggacttgctcccccgccaggcactcagaaccgagccctcggctccagagcccctggcggtgggtgcccacagcacggtgcagacacacagcaagggatggggtcaggctggaggccctgggctctggctcagggggccacttactgggaagggtaagagctggagagccatgcttcacacctgcccctgttgctacccagtcccaagagaggcacacttgaccaccagcaggcgggtgctgggcagggccttgctcacctgcctcagttcccgggggccccacctaccggacccctggcaccacgtggtgggactcagtggtcaggcaggtgtctgatcagctggagggacggcaagcaggggctctgctaagccaccacatcacagaccctgagacctaggccatccggcatgtcccgtgatgcgcactgaacagctagtcctggctcagagctgctaggacccaggaccagctaggagtcgccatgggaactcggctgctggcgggggccagggagggctgagggcagcggatggtgaatcagccgggaggaggccaaggcgtgaagctcggcattctcagggcgtgtgtcaccaaggagcccgcggtgctggctcacccaggagccaggcctgccaagcagcaggagcagggcgaggaccgaaggctgtggccctaaacaaaggggccttaattccacctggtgggggtgagtcatggggcctcctgcccacccaggcgccatcacctgacagcccctccagccggcagggctcacacggacatagcccagtaagggtcccccaagtgtcctgcccctgccacatcccgggtacccccagctgcccctgcttggctataccctcagcagcgtccaggcaggggtgtggcttgagatccctttccggactcctgcctggaacagcctgggcaattgcctagcctcccaccaccgccacccctgcaggaaggagtccctcccaagagctctgcagagaggaggccccgatgccactcccaccctcacaagcacacattgggtcagcaggtccgagtgcgcagcagagctggcagggcagggacccgcagccggaggggaggggagggcggtggctgcaaaaacctctgcctggcctctgtggggtgcggggatgggggagtaccgcctcccgccccagcccctccccatcccctgcctcctgggctcagctccatgtttccattttagaaagtgcttctgactattaaatatttatccgagcaaggaaggccttgactcccggccagccgatgacttccaaaaaaagaaaaataaagggaaatctggaggcccaggctgagtgcaggtggggcctggtggagacaccctcaagctcgcagcgtggctggggatcccgtcacccttagagcgggtggaggggagcagaggagcatgccccgtcctccttgtgtgtccagttaagcctccgctaagctcccttagctaacctggcctccacatcccccacggagcagcttccttcccaccaaaactgccctaagacctatggggctccccggtgccctcaggacaaagccctccctccagcagctgacgctgccacctctccatcctcaccccaccccgtcccagatgcactgggttgaacaacttgcaggtccctgacttcgccctcagcctctgcaggctcctgctgctttgcctccgcttctttttcatgaccagtcccggtctccattgggccagttgtcctccagggagccctctctggcccttctgtgccccctaaggctgcactggccacaaaaatgggattcacatttgttgactgaacaatgggtggatccttcctctgctgagctatgacctcccaggtcccagggttcccggggtggctttgagacccagaaggatgggtgaacaggccgccagacagacggggaagcacccccacaactcacaccatccctgagcgcagggtccgtctctgccagccggaagaccaagctgggagagtgtggcattttactcctgaagtgggtggcagggacccccagatggccagtgccccccacttgctggggcttgggggcctttcctccccagcacctatacttctccacacctggccaagccagcccctagctgagcctgaaacacagaggccttccgcataggtgtcacaagaggaaggacacagagcgggccagagtctaagggagagctgggagtgggcccagcaacccaggggacttcccagaagaggcagctcctagcccagcccaggacagaagagcttggccaaatggagagaaggcaatgagggcattcctgttgtaggcccagccacgacgagcccggatgggagtgggcactcagcttcctgggcatggagaaggccgggagggagcgggctcctggggcattggaactggaggctctgcgggcttgaccctcctgtccacttctgagcctcacccccttccctgagctgcaccaggtgggcactgcctgaggcttggggcaggagccagaggccagcaggcagcccagcctccctccctggtggtccagcttctgtttccccaccagggaaagagctggggttgttaggaacacacttacagcatcactgtcggtggcttctgagaggccacctcactggagggcactccaggatgccctctgctgcctcctcctcaaggcccattcctgccactagcggctacagaggggctcctttgcctgcggtcaccctgcctggtggggcagggcagagccagcacctgtcagaacagcatgtcaccgaccaaagcgtgcgacattctgctctggcccctaagagcccagggagtcactgcgtcactgtccccagcctcagtgtccttgtctgcagaatgggaatacagccctcccccagtgtagatgacccagtcagggagacaccagggtggtgacagacccgcccgcgctgtcactcggcatccctggctgcgtggagctagcagcacaggcagctgcaatcactcctgaccccgaatgtgaggtcctgacccacatttgcagcctgaggccctgaagagggcaccagcgaggcacagaacagcgagaccacctccacagctgccttgctttgcacccttcttgggaaagggcccagccatctcatgacccccaccgcagagaagagaccacccacacatcttcgcatggtatcaccacctggggccttcccaacacggtggtgctttcttggggggtcgtgggaggtgctcaggccacaccggggcagcaggtgcagggtgggggccggggccggggaggggttccctgtctccccagttatcaggggcccagctctgcccctgggaaagaggcaacctgcccctggagtaggcaagagtgtgacacccagagcccactgggagtgaactggctggtgttacagtcggcagcgctgcgtggggtggtcccagcatggccaccagggggcagcctcggcacaaaagccgcccaggagatggctccctgctgggctggtgcctggtgtgtcgggcagagggcaggtttggactggacaggaagacgagagcaggggagagtccgcccatctccagcctgctgagaggaaactgcaggtggaaaaggcctggaccaaatccaggctgggaaaggcagtagttggcagggtgcttgtcaggaatgcacgttcctgggccgcagggttggggagggtctgggaaccggtgtgctggacagaactcccaaggtctctgatcttgcaagtctcctaccaaagctccagcgagagccactgaccttattccctaagagcggatggttccgtaggctggacacagggagggactgccccagacgggctgggaaccatgaagccagcacaagcctctgtggaggcagggggtggatgagatggtcctggaccctgcagcttgggagtctctgggtgcccgtgagtgaggaggaagcagagcagaaaggctgtgcagggaagctgggggcagggtagtggtcccatgcctgggggccctgcccttctccctctgaggaggtcgacctgcagccatgtgggcagggccagtcatagtgaaagaggagggggccaggggcctccagcccaccggagccatcatcctcccgctgctgtgcccaaacaccttgggctcccatctgcgacaccgtgaagcaggtgctgtaggggcctccctgctctggagccccccagacaagcctcccaccctaagtgcgcaccagacagacaggccacaggaggggccttggtagtgcctgctgcagctggggggcatgcccaggccaggggcacccctctcacctgcagcattgtcggcaccattagcattgacctgttttccccaaggagtggggtccagcctgcaccagtgccggccagcccaaccccctggccagtggctgccaatgccctgggtgtggtcagctgcagcagcatagacccagcgcccaagggactgccctgcccccctcagccctgccctccaagatgctgagacacccaggccccggaaccaggcccagtgcagggacagacacacaaagagcagcaggtacacatgccgtagcctgcggctcagagggaggctactgaccatccctgggggcatgccagtaggtagcacccactttcccttgcccagcactgcgggaccctgtggcctgactttgaccccattcaggcccctcaccaggccccagacctcaggcctagccctgccacagcctccacctagccagcgaccccaccacacagccacacagtagacgcagcccagccctgcctggaagccccggaccaaagtggagagcccagactcctggaccagcctggctgctctcccgcaaagcaggtgagagggcaagcctggtgcaggtgccccgggtcccggcggccccggctttcacgccccttgcagacaccagccctgctccagagtgcggtagcacctcccaggaggccgcctctcgaccagacagcgtcccaggagcggggcaggagcgagaaggagagacagacagggaccgcgagtgacagagggagtgagcgacagagacgagtcagccaccgagaaacaaagtgagcgacagagacagtctcagaggccgggagaggagcaggaacctacagccacggacaggtagaacgcgaggcatgggagaagagactccagcggccgggaaggcccagaaccacgcgcgagtcccgcaggcgtctccgagtcccccgcccccaaggcccgcactgcgcgcccctggacacgccccggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctccggcgcacggggcgggcgggcgggagccgcgctctgccccgctgccctgcgctgccgcgg

SEQ ID NO: 1329 - DNA, 27845 bp, Homo sapiens
attaccaggtcaaaatttttattcgttcattcatttattcatttgttctgcctgtgcaaggcagcctcactcccaggctgtcagcaggactttttttttctcttttgtacagatctggttcttggctttgctccttgactcagttgacctcctacccctcacagcagggtaaagacttgcacatcactgacaggcggctcggagtcagccttggagtcggccttccatgcccagccctgaggccaccatgccacgttccagttggctcaagcagtgaggggcaaaaccagctccagggccaggtggaagggctgcttctctcctgcctccatcaaatgctgaccttgcctctgaatgaccaagcaaaacaaaggaataaatgaatgaataaaaattttgacctgttaattccttaagaccttgatacgtattcgtgggtaagcaattttatactattttataaaactgttttcagctgttttagtcagggtcgggtgccaggcacctagacacccccctccccattcccaggaaggttttggccaaacctgcatccaccaccttggcatgccaacgcattcgaggccctggcaggccccgactcaacagaaccgtctcgccctctacagccaccacagccacgtgggccaatacccagcacgcgccccactgccccaagcctctctgccggcgtggctctcccccaacctcactctcaatacaaaagggacagcaccgaaagaacaagggaggccggaatggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgag

SEQ ID NO: 1330 - DNA, 8388 bp, Homo sapiens
agctggagctatgcaagcctttattggggtccgcggggtgtggggtgagtggccaagactggcctctgtctagaaccctggagtctcactggagatccaggttgggggccacctggctgaggaaccatgagacaccaaagatgacgccgagggtcttggggatgtccgggtcgtctgcaaaggcctgggcgccttccaggggcaggtgcaccacctcaatgagctcaccctcctccaccaggcccccacctggaccgctacgctgggcatctgtcacctctgtgtagaacatggtctgtctggagccagtcagtcccactccagacctacgggttgagacagggtctgctgagtcacccacgctggccccgctggccccctggcccttctaccaccctccaacccaccctctccactctgctccctccagccctccagtaggcaggactctgggatgccctctcccacccggattcccacctggtgtgcacgcccgtggcccctcccgcagcagggcatcccttccctgatcacgttgtactcgccaggtggggtgggtgttgtcgatgtgattaaggaccctaaccggtgacttgagctcatcagaagggagagcatcctaggcgggcatggcccgatcacgaagccctccagagggtgtttcaacgccagaaagggagaaattcaggccagtcctgctggccctgaaggggaagcaaccgccatgctgggaagggccaacagccagcagggaggtgggacccagtccccagccaccaggagctgaattctgccataacctcgtgagccgggaagaccccaagcccccatgagattgcagatccggctgacaacctgcctgcaacctgtcaaggccaagcagaagaccccacccctgtctgcagcccccaaccagataccctgaggctgttcccagtgctgtttggagcccctcagtctgtggccagctgcagaggcccatgccagaccccagcccatacccggggacacaggctggctgggaagcagggacaaacccaccaggccttcccgcaagggttccccaccaggcacccacaggacacaagtttcagactaggaacagcatgcactgaccgcccccccaccccccgtagcatggcagagtggggtggggtggcagcgaggtcctcagtaccaggcccagtggcccaggctggggaggggtaagaggaagccccctccctcagtgggcagtggccagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttgccctctagcccctcacctcccgcagaccccttcctgatggcccatttccggcggcggccgcggctgcgcctctgagggaagtggcgggtctggggtttccagccccggtttccgccggcttgtgaaggagacaggcccggcccttggcccgggctgagaggaatctgccagccaggctgggcaacgcctcccccaccccagggcacgttccaacttcactccatcacgccccaagctgactgcctccctgggccttgtcctttgcagcggcaggtaagaggcctggctcacctccagaatcagagacagggagccacgggccctgccacagggtgggtgaactttgctgtcagtccagccccccatcaggccctcagagacggacaccctgacccctagtcagcagcatctccagtcctgcatccctgaagccacggcctgctcttcccgatgcgagtctaagcaggatgcctacttcccagagccctccttggctccccagcaccctcacaatcaggctgtggcccagaggctgtaccagtagaaccaccgcggccagggctgcttgaccacttgccctgagagcctgtgcggtccctctgccaggaacctgcccaggcccacctcctccagggggaccaaggggactccagcccctcccatgcctcccggctgtgctcagtactatgggctggggagctgggggcacagtgggcgtggcccaccacggggtagacacctgcagaaaaccaaggcccatccttcacacccaagtccacccttcggcatggaaattctgttttgttgagacagagtttcgctcttgttgcccaggctagagtgcaatggcgcgatctcggctcaccgcaacctccgcctcctgggttcaggctcaccgcaacctccgcctcctgggttcaagcgattctcctgcctcagtctcctgagtagctggaattacaggctcctgccaccacgcctggctaattttgtacttttagcagaggcggggtttctccatgtggtcaggctggtctcgaactcctgacctcaggtgatccgcctgcctcggcctcccaaagtgctgggattacaggcgtgagccaccgtgcctggcccagcgtggaaatgctgcctttaacttgggagtccacccatccagccaggaacgtgcccaggtgaagtccttgaggctgctgaggtgggagggccccaggctcaaccctgagtggcccatgtgccaggctgacaggtgcagagacttccggtgcttctcccagtggagcgggccctggcctctggaggaggctgtggaggctggtgctcagctggtgggggtgggggtctgtgacaccctcctccttccccaagacctcagctggggtcaggagcccatcgtagcgtccctggggaagtggatgggcttcataccaacatctagtcctgggaaggcaaccccaccccagctggcagccctcgcggggcaagagttggtgcctcgagtttggtgggtcaggtcccaaagcgcaggctctagtgcctgttccccaggagagctggagccaccccttctccagcccaggacacagcttctccctcattcctaagccaccctctgagaacagagctgtgagtcacccccacccccagcgcccggtcttaatcctacaggaagtagaggcacctgtcagcagcagctgtcacccggcctgcctcacacagctgggggccgcaggctgggggcatggggccgagacgctgcagagagagccccaagagcccagattctggcctggcttaggagctgaggcgcattcggtccaaccctcccctaatcccatgttggaaaacaaggaggaatccatcctgcttgcacactcccagggacggggccctcactctctcccatctcctgagtcacaccacaggcctgagggcctggtcccactcaccagtatgtggcgacccggcgcagatcagagggggccaagtggtagccacactcctcccaagcctccttgcaagccacttcctccagcgagagcccaggctggtccacgaggccggcacacagctcaactgtcacccccgctgagccgggcagggctggctgtagctcccgaggcccgtcctggtctacagctgctagggaccctgggaagcggcgctccacctcacccgcatacacagctgcgtgggaagaagccagactgtgctcacagccacgtggtggccacctccaggtcacccacacagccaagccccctcccagggcctcagcttcccctggagccccctcccacatctgtattcagaccctcaggaccacagggacctgaaggtgaccctgcagatccccttcccaccccagctggcctcacctggccggaactgcttcaccaacaccaggctcctccgagaagagttgaataagagaacggtcacgctgtgtacggggggaggggctcagcacagaagcactccactggccctcgtggggccccacctcccatctttctgttcccagcgtggccatcccacctccttgccagcagcccagggaggtcaggccccttgctcagataggatggctgaggcccaggcgggaccagagctttccagggtcacagtctggccaggacccagacctgctgtattccagctggcaggatgggaggcggggggcagggaaggacacacgggcagctgagtaggtcagggtgctcgcagctgaggccgggtgactgacaggacgtttggccctcactgagcagctgcccaccagccacactcctcgagccacgtcgccatccagcccagaccctggatgctaggggcaaaggctccaggacagcctctccctgccctgagagggcctgcccaccatcatggtcccggtggcctgagcaaagacctgactcagcccccaggcctcaggctgacccctcagggataggaaacccagaggccgggcagagagaagggacttttggagcccacgcagggaacagcaacgtcagggaggagagggcaccttcgccctgggcccagtgtccccgtagacatcagtctggggcttccccagtggccaggctgggccaggctctcacctgtcatgcgtcttcatgaagtcccaggacttctgggcaccattctagaaggggcaggtcagcggttagaatgtcccaggatgggcggaggtgctcggggaaccgaggaggccacagacccattgcacccactcctaaccagggagatcggctcgtggcctgggcccacgggagccaggaactgcagctcccgtgggcagaggagcaagcagcctgggaggggcagggaggtcaaggacagcctaataccctacgagtgaggcagaagaccagggcaaagggcagggaaggtgtccaggcacctcatgaaacactgcccagcacagaccgagcacaaggggctgcagagagacgtacaccgtcaccaagtataggaaggctcatggaggctcggggagggcaggcgtgactccctcacagcagggcaggagggccctgcaggcagaggagaggtcaggttttcctgctgatgcttccttgggccactgaacaggtggagacgggagggcaggaggggccggcaccaggagtggatggggaagggtggcaggaggggctggcaccaggagcagatgaggaagggtggcgccccagccaggtaggagatcgcactgcaggactcggtgactgtcatgatggtgaccaggctcggcagcccccccacacacccctacccccagtttctggcctcgactctcccacataccctgtggtcccgttctcctgtggccaccctccaccttcccactcccccacactgggcacaccaccctggcaggcccctgcaccctgggtggcactcagtgaacggaggaggcagggtgggcaggtgtgtgggctgggcctgctgggggaggctggaactgatgcattctgagatgcactcccatcctgggggctgagcctggggtcccgcggggtcccatctccggcacgctcagcccatctgccactctgaggcccaggccagctgctcatcccccaccgggggctctgcccagggctgtgaaatggacaagaggtctgagcagcagagacacagaagtgcagccaggactgcagaagagagaagaagccttcctgaggactttctggaggaggtgacggaagtgagggaagggactctgggcaggcagaggcgcagaggccctctgagcttggccgggaggcaaaggcgtcctgggaggagagtaccggtttccaagggaagggagggccggcgtcccgcgcaggtcaggcagcccgagaggccgtggggtaccactcccgggaggcgaccccaggcctgcctgacacccagccacccccgaaccaccacccagccagggcaggctccagggaagccccctgcccacagcctgccatgtgcctgctgtgcccatgccccttccccaccactgcttccccccgagtaacatcaccccatgcaggtctcaaggaccctctcagctcaaggtcaaaagcgtgtcagacccttaggtccagccaggtcaaggtgcagggaggtttagggaggctgctgaggcctgggagggaggggcagggctgggtgcaaagaagaccccatcgcctcggagccacgggggtcccctgcctttggtctgcctgacatcacaggcctcccctggctggacgcagcaaaaagctgagggctgcagctgcccctgggtggcagccagcgtccagcccaatgtcccttggccctgaggagatgccgcccagcccgagcctacatccgtgtccaccacagccacagcccgaaccagctcagctctggtcaccagaacccttcagcagagctgtgccggcgggctgcccgctgaggctgcaagggctgccctgaggcttcacggggagtgagggagagagtgctgccaccagggccacagagggcacctgcctgggcctgcacctgctgcctgagacccagccctgtggggactgtgcagccacaagcaggcatcccatatggccaacgtcagggaaaagggcagtgaccccatgtctccacctgctgtaccccgactgatcccagctgccccctgccagcaccaccagcttagcttcgccttggggagagggatcccctgtcctccagcgccaacaggactcccgcaacagggaaagtgaggggcacagggcctctctcaggctgggggccaagagggcttctccaggatggcgaggggcagagtcctggatgtgatgggggggacaggatgccccctgagggagggaggcaggcaggcagagaggcactgcgacctggaccacctgacctgataggctggggggctggactgactgtgaccaggaaggtggtctttgccttaatggcatgaaggagctctggcagaggggagatctgctgggggcaggtgggcatgcaagcaaaaggtggggccctaactggacagggctgggcttggaggaagacggcccgggactcagtgatccactggatgtgggaaaaggatggcagcagctccttcacccaacacatatgcctcatgcctgtaatccccatgctttgggaagccaaggcaggaggatcggttgaggccagaagttcaagaccagcctgggcaacagtgagacgtcgtctctacaaaaaaatttaaacattagccaggtgtggtggtgtgcacctgtggtcccagctactggggcgggggctgaggcaggaggatcgcttgagcccaggaggttgaggctgcagtgagctgtgaccatgccactgcactccagcctgggcgacagcaagaccctgtctcaaaaacaaaacaaaacaaaatattccttgtgaacctaccatgtgcctggtgctaagtgaggcaatacagcctcttgtgccgtggcctggcatgggagaaggtgacaccctaggaggtggggaaggctgagcttaggcagatggagactccaaggaggtgccctccctggaaaaaaccccaaggaggaagcctgctttgagaggctctctcaagttctcactcagctccttctcctacctccctgcgcccggcctctgcgctccttgctccctcctcctcggcccagctatctcctccttcaagtggtagcatgaaagccaccacttccaggaagccttccctgatccccagggcaaccaaggagttccactgccaagagggtcggattgggcgggcgggaaggatggggcccagcaatgcttccttgaaaggatgagtggtgccccctcagatgtccctcccgcggcccctccccggcctgggggctcactgggtctgggaacccgcgatccggcgggcggacaagcggccgcccgggagatcggcgggaggcgggggcggggctccggggcggggccggcagcgcggaagatggtgggcggggcgcgggtcgtgggccgggccgccggcgggggcgcgggggacgcgggggcgcgggctcacctggcggtaatgcagcgtgagcggccgcaggtagggtgaggcggcgcagcggcccacggacgccccctcgatgcgctccatggcggcgcccggacaggcgggggccgcgagctctgcgggggccgacacggggcggcgccctgtcccgacaggagccttcgggcgggcgcgtgaccgcggctctgagcatgctcc

SEQ ID NO: 1331 - DNA, 27845 bp, Homo sapiens; identical to SEQ ID NO: 1329

SEQ ID NO: 1332 - DNA, 38601 bp, Homo sapiens
atttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccac

SEQ ID NO: 1333 - DNA, 106293 bp, Homo sapiens
atttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccacgcacctcccaggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctgtgcctatttcctcgaggaaaatgccgggaaatagcagcgcctgcccctgtaaagccctcagagcagagtggaccgcgctctctgcaagcgctggctgctggcgtccgtagcaagctaaatcgcgaagcatctgaacgaacgaggaagcccaacgaccatcccacaggccgcggccagaggcagactccggaatgcaaatggccaaacaagcaggtccacctgcgttcctaaccaaaagatcgctaactgaagaacgggcgcaagcacctgcgcatggcactgcgggtctgggggcggccgcctgccagcgccgggagccgccttccacggctacctctgcacagcgcgcggctcgcgccggttgctgggcagaagctcgagcagcttcgaggatgtcgggcctgggggcggggccgcgaggcagcgacgtcgcgcggggcgcggccctgacgcagcgtgacgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatagggtgaaacaggctctcccaccccttgtctctctcctcccactctgcataccctgtaggcagttgttttctggaaaacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccagtcatctgcttggtaaagaaagggtaggtcagaaccatcgggcagtgagtgctgttttgatcctttccttctagacttttccgctaggttagattctgcatgcatgaacactgctgctgcctcgagggagagacaggacttaccctacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtcccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgcagtgagctacgattgtgccactgcactccagcctggacaacagcgagactgtgtcttagaaaataaggccccacattactgagctcctagcagctttaagaaacatttcttaccttgaggggtcccatgcttggacaggatttccctccactgttcaaaggacatttggcacgctggtccctacagcagcctgccggacaccccagcatctcacccagatgcctacctatggccggcgcattgatgcagagctctcttgccaagagaagaaacgtctttccaagcacgtacacattcacctgagatggagagatcacaaccagaaacagcattggtatttaaggaaatgtttgctttttttctcttaaaatgcatctcttgtgcagtctttaaagactccgatggcccgtggagcagccaccccacacccgcaagcctggctggcctcccttggctgctggggctcccagggccctgccttcttcctctaagccgctgctttaggccgtgctgccgtctcgccaatgatggcatctgcttagaagaaaacctgactgcaaggttcctcccagggcgtcatcacacggtgcacgcagcatttcattcacaactgcacacccatgaacacaaaaccagttctgtccacatgtgctcccaccagccacacctccagcccagattccgatgggcccaggggtcttggcctcagcccccttgctgggactgagatctgtgttcctcagtgactcccctgccccccacactgttcctaccttaggtccaaatccacacagatcctgtcacccctgcctcggctatctgccatagggcagtggaggtgaggcccagaccgagaagggcaacgccgagggctggcagtgatgggagcaccgctgcttgtcctcagcaaaacaaggactctagcctgtgtgcagaccctgtgcacagccctgccgtgggccgagtacccctaaggagccctgctggctgggggaggacacttcagagcaatgtctgctggcaggtgtggatgaggtgcacagcgggaatagcctggtccctactggagcctgcaagagccctgcccacacttggctgtcttcatcccaggcttgcccctggggcccccgggcctcacaggcttggccagtctgaccctctgccactagcctcccccaaagaattccctcgcctgaccaagcccggctcgtgggcccttagacaagtccccttgtcctggcccgccagtggcacttccaggtgcttgctgactccagggtactgggagacctaagggaccgcacacaaagggtcctgtctgcgctagaggcaagagacagaggcaagagccagaggcagcgcttgtgggggatgcctctgatcagggaccctgcccgctgggagggctgggcccccacagcagctcctcctggtcaccatccaccccagtggggcgcagcttccatcttctccattatatccgagggctccatcacaagggctggtggctcacagagtgtgccttctgaaggaatttcccctcctcacagtttctgggggttccagggatccctggggtctgctcaccaaactggggggcgtgtcagcacatgtagtgtgtgtgtgcatccgcatgcagtgtgcagacatgcatgtgtgtacacacgcatacagtgtgtctaggtgtgactcacgcatgtcatgtatgagtgccccagcccctgtgctgggttcctgccaggcccctgcatcttgatcgtcctgatcccaccatctctctttaagccacagcagaaccatgatctgctgctggcctctgcctgcccacctcaaactccacaccccccaaccttgtgtcccagagacacagggatcaatgagacctgaacactgcaagtgaggaatctccaaagggcctttacatggaaactcacgtttaaaaagccatgtgtgcaaaacgcgtgcagtttttttgttttagtttgtttgtttttgagacggagtcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagacaggatggtctcgatctccagacctcctgatctgcccgcctcggcctcccaaagtgctgggattacaggagtgagccaccgcacctggccgcagttttttgtttgttttcttgagacagagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgttggccaggctggtcttgaactcctgacctcaggtgatctgcctgcctcagcctcccaaagtgcggggattacaggtgtgagccaccgcgcccggcctaaatacatgcagttctttacagagttgctaccatgtatgaggaccatttattggaaattctcttgctaacagtctaactgtggctgctccttgagggcaggtcagggtggggcacagccagctgccccccccatctctcttcctgggcagcaggtggattctgcctgcagactgccctcgtgggtgtctgatgagctgtgtgcccaggccagtgaacaacctgggtctgccctaaggcagggatcaagagggagactccatgagctcgccatgggaccatctgagtccccaggagcctgaccacttccggagcagctgccctggccctggccctcatactcatcttccctgggaagtcgtggggttggaaccagggtcatgtggttttgccctgcactgagcagagagcatctgaaatgtggacttgctggattatcacaattccagcagactatttttagcttgaccacaaaatgtttcagcagtagcttctgagttgccatttataaagacagctgggaggacaaggaccccagatgccacctgacacgggcagaagcctaactgtgggctgctgccaaaggcggaaagcccttgaggaccagaggtggcagcacagcctgtgggtgcccagaacccctgtgggcacctggatctggacagagctccctttgaggagtgaaatctacatgaattctgcactgtggtcacaactgttttcaatatttctgagtcctcagcagcatggtcaccaaggacctgtggtgcagcccccagcaccgtccctgcagagcctcggtgcccccaccctgtatcctgtctgcacaggggtccctggggttggtctttccactctgtcactttgttcagtcatgtggaaagagagatgtaactgaaagtgctttctgtggtacccagaaagtgagtgtctccaaacagactgtaatataagatttttctacaatttaaaatgcatgcaagaggccaggtatggttgttcatgcctgtgaccccagtacttagggaggccttggtgggagggttgcttgagctcaggagttcaagagcagcctgggcaacatagcaagaccccgtctctactaaaaatacaaaatagccgagcatggtggtgggcacctgtggtcccagctacttgggaggctgaggtgggaggattgcttgagcccaggaggcagaggttgcagtaagctgagatcacgccactgcactccagcctgggtgacagagcgagactccatctcataaataaataaataaataaaatgcaaggtcaaaagaaataatctcctataccaaactaggtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcaggaaggaaaggtggtatggaagcgaggcgcggcacgctcaggcctcaccagaacctcccagccccaggcacaagtgagacttctgtgaacccagtaccaggacaagggactgcaaggaacctggagccgggtcgggggaaccagaaacggtgggggcttccatctgatcctggagaaagcgtgcacccccacacacccgcctgcccagtcaggtgcccaccatatggtggatctgctgcccacacacagcacagaagagacagtggcactcatgctccatcccaagggcacttgctgagcacctatcaggcgtcaggcaggcagtcctcccgagagacagaaaactagacctggggcccccttggtgagtggtgagcctgcaggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccacgcaagaacctcgcaagcaatcagatggttaggacgccagcccactcatccacgccctgggctggaggcccctgacctctcttgcaactccatgcagaacagcaaggcctcccaccctaagaaggtgccagggctgggtacaggggcattccgacacagagcagaacccccaggacggctgggacgtgagcggtgaggcccgtgaacaaaggtgcatctgaaggcaggcagtcccagagggccgagacaacgggcaggaccgactgcagcacagccaacagcctcacaagaggcactatgagaagaccggcggcaggggtggggccagtgacatcaaaggaaaccaaaggaaagcagtaagaactacctggggaaacgcccgtgacagccaacacacaccaacgggaaaagtgaacgaggccagaaggctacaccctgtgtgactccaagcatacaccttccggaaaaggcaaaactatggagacagcattaggtcagtggccaccaagggctggggaaaggcagggtgggtgggccgagaggagggttccaggacgctgcagctctgcaccactccgcactggtgggttcacatattgcatatttgtgaaaacccatagaaggcacagccccaagagtgaacctcaatgtgaactgtggacttttcttatcaacaacttggcaagacgggctcatcaaccataacaaatggaccagctaacacaagatgttaataacatagggaaattggggattgaagggggtgtatgggaactctgtactttctacacaatttttctgtaaactaagactgctctaagaaataaactctactgggctggacgcggtgactcacgcctgtaatcccagcacttcgggaggccgaggtgggtggatcacaaggtcaggagatcgagaccatcctggctaacatggtgaaaccccgtctctactaaaaatacaaaaaaattagccgggcgtgttggcgggcacctgtagtcccagctacttgggaggctgaggcaggagaatggcgtgaacccagaaggcggagcttgcagtgagccgagatggcgccaccgcactccagcctgggcgacagagcgagactccgtctcaaaaaaaaaaaaagaaatgaactctaaggccaggcgcagtggctcacgcctgtaatcccaacactttgggaggccgaggtgggaggatcacctgaggtcaggagtttgagaccagcctggccaacatggtgaaaccccgtctctactaaaaatacaaaaattacccagggggtggtggcgggcacctgtaatcccagctacttgggaggctgaggtgggagaattgcttgaacccaggaagcagaagttgcagtaagcaaatatcgcaccactgcactccagcctgggcaacagagcgagactcagtctcaaaaaaaagaactctatttaaataagaaaaagaataaaggccaaaataaaaaaaggcaaaacaattcaacagaagcttcatgaagacaaaaaaaaatagccaacaagcacatgaaaaagaactcaactgcattaatcatcagaaatgcaaacaaaactgtgacaatgccacgagcccgcgacgtcactgaatgccggcgaggatgtggggcaagcacagctcacccatgctgctgatggaagcgtgaagtggtacaaccaccttgggaaaaggcctggaagtttcttacaaagctaaacacacacctctgacccacctattccactcctaggtatttacccaagagaaataaaaacagatgtcagccaggtgcagtggctcacacccataatcccagcactttaggaggctgaggccagcagatcaccagagcccaggagttcaagaccggcctgggcaacacagtgagaccctgtttctacaaaaaaatccaaaaattagccgggtatggtgacaaacacttattgtcccagctactcagaaggctaaggcaggaggattgcttgcacccaagaggtcgaggttgcagtgagctgtgattgcaccactgcactgagctggggccacagagtgagactctgtctctaaaaataaaaagaaatatgtccacaaaaaaacttgtagaaaaatgttcatagcagcttcattcagaacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagagctacattctgtcaccaaaaaaaaaagcatgtgaagtgacagggcacagatcatatgattccatttatagggcattctagaacaggcacaactggtctgtagtggaaggaaatggaaacagcggttgccttttgcggggctgggactgttggaaggggcatgaggtctgtccacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagacataagccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagctgcttctgaccatctgggaatcagaaaaaagtctgcagagaagaggccctgtctgcggcccccagggtgcgaaagcctggattctgccagctggggcctctttctgcctcccttctggcccctgccacgctgtgccgggtggtcttctgctcggtgcagctgagtgccagtcaaaggagagacgcgggagcacaatagagggcaggtgacacaatgccctcaaagggcgccagacattcctgagtgcggcagaggcccacgcgaggctcccatcagcagatgacaaggcccagaaatggtccagtcatgacggtgcagccctgcaccccactgctgtgccatcaaactgtcccggctccaggaaccaaccaggcttccccaccacagctgtggacaacacagcgaggggccactccactgtgaagaggatggggaaactgaggctgcccacaccctggctggctgcacgatgcttgcagggagaaaaactgcagatgggtcctgactcagacacactttccttacatggaaaagtttacagagatttacataaggcagaactaaaacttaaaaaaacaagaaatttctctcaacagcctcacatacaaatgctcttactggatacccaaagagagaagcgagggaaagtgctcttgtatatagagccccacagaaagggctgtgtccacaacagccagcagtgcaggggccggcagggccccaccctgagcggacaccagcattcccggccccatgggactggagagggggactgcggcgcccacacggcgtgaggaccaaggagcgaaacccacaccttctggagaatgatgcccagcactgcaccggcccacggctcactgcccctacccagtgccactccccttctgcaggccccccctgctctgagtgctcctcaccggcagccaacaccacctggcacgggaacacacggcccggccgaagctccgtgtagagcagtagtgcccagccccaacccaccaagggcaaggccctggcagcactcagcatacagcactcagcggccgaccaagcacccacacaggagcccggcaggcagactgggcatcctcaggccccgcacatgcctggacggggctatgacggatcctagcttggaatggggtcactcaccccagagctcggatgccctcagcaccccaagagcaggacccatcaagacccagggcctaggtcatgagcagccctgccctcccgaacttcccagagaccaccctgctcctccgcctggaggtgtggcacagagcaggtgctctgggagtccctgaatgactgatgcggggtaggagacctgctggctgccctttgtccagatacctctgacctccagggaagagccagtgggtcattgctgggccttgcccatcccctgcacagtgactaaatccctgagccactgctggctgccacaccccacggtgggctcctgtgtgcagtacaccctgaataatctagcacctcaccgctgtcatcatgcatggcctctgtgaagttcaagggtacccaggtgccttctcaaagatccctgctctgaagactgagcctcccacagagctgggagcctggctctgtcccagccacactgaggtggtctcacggataatgcagctgctatccaggcagtcacctgacgctcccagcccctggctttcaagcacacacatgcaaccaggcacatggatggccccaggaggagctgagtggcacgagtgtaaggtgcagtgtctcagctcgggcctccttccaattctcgccaattctaataagctgtcatagtctggcagtgccaggccaggattgcctgaggacaggagttcaagaccagcctggacaacatagcaagaccccatctccatttaaaaaaaaaaaaagtggctggacacggtggctcacgcctgtaatcccaacactttgggaggccgaggcgggcagatgacaacgtcaagagtccgagaccagcctggccaatatggtgaaaccctatctctactaaaaatacaagttagccaggcatggtggtgggcacctataatcccagctactcgggaggctgaggcaggagaatcgcttgaacccgggaggcagaggttgcagtgagccgagatggcaccactgcactccagcctgggcaacagagtaagactccatcaaaaaaaaaaaaaaaaaaaaagtaggagcctagtgctcacagtctcgcttggcaagggaagatagagtttacagttcagtggcttccgagccagccagacacgaggggccaagctgccaagagaagaggaagcaacttcaacaagcgagcagggcacagtgcacttagtccctttacggcagctgccgcccctggagccacaggcaccaggctgaggcccgccaagcccagaagtcagctctgaaaggcaaaagagccgagcaggaagttctgcagtcccgaggtgccaggaagggacacctgggtcctgccacgatccttcagccgggaaccaagacggaccagcagcaactggatcagagtgagctacctgcgtgctctctgcttgctcaagaaaagttaaattcccggccgggcgcgatggctcacgcctgtaatcccaacactttggaagggtgagatgggcggaccacgaggtcaggagatcgagaccatcctggctaacacggcgaaaccctgtctctactaaaaatacaaaaaatcagccggatgtggtggcgggcacctatagtcccagctacttgggagactgaggcaggagaatggcatgaacctgggaggcggagcttgcagtgagcagagatggtgccactgcattccagcctgggcaacagagtgagactctgtctcaaaaaaaaaaaaaaagaaaagttaaattccctctggatggaaaagtatccatcatctctgtaatattttagacctaatattccagcgattcaatgaaaaattaccaagcatgacaaaagacaagaccaaaggaacaaaaacaaaaagaaaatcaagataataaaaacagaaccacaaatgattcaactatttggcttatcaatgactttcacctaactatgaagaaatgaagaatcttaccaaagaactggactctaataaaaggagtcttagtgatggctcacatctataatcctagcacgttgggaggccaaggcaggagaatagcttctgcccaggagttcaagaccaggctgggcaacatagcaagacaccattctctacaaaaaataaagagcccaggagttcaagaccagcctgggcaacacagtgagacctcatctctataaaaaattgatggccaggcgcgattgctcacacctataatcccagcactttgggaggccgaggtgggcggatcacgaggtcaggatatcgggaccatcctggctaacacagtgaaacaccgtctctactaaaaatacaaaaaaaaattagccgggcatggtggcgggtgcctgtagtcccagctactcgggaagctgaggcaggagaatggcatgaacccgggaggcagagcatgcagtgagccgagattgtgccactgaactccagcctgggtgacagaatgagactccatctcaaaaaaaaaaaaaaaaaaaaaaaaattgagtgggtgtggtggcgcatacctgtagtcccaactactatggaggctgaggtgagaggattgctcgagcctgggaggtcaaggctgcagtgagctgtgactgcaccactgcactccagcctgggcaacacagcgatattccatctcttaaaaaaaaaattaagaagttagtagatgggttcaacacctgattagacacagcaaaagaaaggatgagcaaaagagagaaaggctaatatatggagtcccagaacaggaagagagagtggagcagaaactttatttgaaaagatactacccaagatgtctccaacgtagacaaaagacatcaagtcataagttctacttatccttttttttgttttttttttgtttgtttgtttttttagagacagggtctcactctgtcgcccaggctggaatgcactgatgcactgatgtcatcacagctcactgcagccttgacccctgggcttaagtgatcctcctgcctcagcctcctgagtagctgggactacaggtgtgcaccaccacacctggctaatttcttttattagcctaggctggtcctaaactcctggcctcaagtgatccacccacctcagcctcccaaagcgctgggattacacccataaactaccacacccagccaagtcacaaatccttgaacttctacaaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaatttatagcctcgagtgcttatgttagaaaaaacaggccagatacaatagctcacacctgtaatcccaacactttgggagtccaagatgagaagataactggaacccaggagtttgaggccagcctgggcaatacagtgagaccccatctctagtgcacctatggtcccggctactcgggatgctgaggcgagagagtcgcctgagccagggagttggaggttgcaacgagctagggtggtgccacagtggtacagcctgggagaacagagcaagaccctgtttctaaaaaattttaaaaaattaatcagtgttatttacgttaggtaacagattaaggggaaaatgtacatgaaaaaatcataccaataaatacattggtgtttgataaaattcagtatttttcatgacaaaaactcttggaaaattagaaagcaaggtaacatcctcaagctgataaagagtcctatacacaaaagtctaccgcagatacatagagcgaagggcagaaaacacccctcccaggacaggagagagccaggcacatctccctccccaggaccatgctgagtcctcggcatacaaaaggcaggacaaacagatgagaggtgtgtgggttagaaaggaagaaccaaggctgggcggggggttcacacctagaatcccagcactttgggagactgagggaggcagatcacttgagctcagaagtttgagaccagcttggacaatacagcaaaaccccgtcgccacaaaaagtacaaaaattagccaggggtggtggtgtatgcctgtagtccagctacacgggaggctgaggtgggaggatcgcttgagcctgggaggcagaagctgcagtgagccaagactgcgccactgcactccagcctgggtgatcaagtgagatcctgtctcatgaaaaaaatgaaaagaaagaagcagaactggcattatgagcagcagacacagttgtgtgcattaaaggagagactccaaaactcaaacagtaagatcgacaattgaatttggtaggaatgatgtattaataatgtcaacatacaaaactcagctaaacctctgctacgccagcaacaagacaccaccgacaaggggcccacatgggcccacgctgggtgtgccggtgtttccaggtcagcctttcggaagtctgaaatggcaacttttttttttttttgagacggggctcactctattgcctaggctggagtgtagtggtgcgatcatggctcactgcagcctcgacctcctgggttcaagcgatcctcccacctcagcctccccagtaggtgagaccacaggtacacaccaccagctggatttttttttttgttttctttttcttttgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggcagaggccttgctcccacgcgtggccaggcacgccatggaggctgaggctggcaggccatggaagctgggcatgctctttgcagacctacgtggggacaggtgatggcaccatccacagtgctggccccagggctctgacgccctctagggctcaccagcctgtcaccatcccaagatgccctctcacatgcaggcctagggcagcctggctggacaggaacaaatgtcaaagacccacaaaccagctgtgggcaaaagctgcaataacaagtcgagacacacagccaggaaaagcacactggccacaaactacctgctcgacaatggcagaggtgctcattccagctgagtctctgcccggcatgtccaggtcccgtgtctcagccctgctgcccacgcagcctccctgggctgggagccaggagcagactcaggcctagggtcagccgggccttgccagactcagtgggactcagcagcaccccgttcctcctccaggaatccgggactggctgtgtcagccaccaggctacggggccaagagaggaggtgtgtgtgcacagcccccggcactttcggggtgatagtggacacacctgaggatcgggcaacaatgaagggtgggcagaaggaggaataagcttggatgttcttaaatcaagcccttgttccttctgagagaggatttcttgtatccagccctgggctcagggcactggtcccacccatgggctggacgatacgataggaggatcctggggggcctctcctggggtgggggccatgcaccccacaacgtaagctcactgcacaggaccctccacgtcctgctgacggcagggtggaggtggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcggtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtccttagcagctttataaggtacaagtttgtgccacaaacctgcctgttcacagtgcaccgggcagtgggttttcgtaaatccccagagctgagcaaccaccaccaggatctaattttagaatgcgtgggggacacggggtggcttcctggatgctgccactgtgagcactgtgcgtgagcctcggtggggacacaggtactcttttcccttgggcacacacttagtaggaggatcgctggagcgtgtgggaactttgtggctaaaggtggtcctgccagactcagaggcagccccggcagtgccacaggactgctctccgtcctgcctgtcatcaccccatgaaggcccatgtcccagggcatctgtcccccccacaggaggcccagtgaggcagcagcatggacgtggttccaccccaccttgctgacgctggggtcccagtgccggcctgcaccctaggccctgctccacagcagtccccacacagctcctacaaacacaagggaggcagggccatgggctgaccctgggctctgctcagcttctcgctcaggaccttggtctgcttctaagagagcaggatcggagcaggcctctcagtgggaccccagggtggagccggggcaagcagacagcaggcggggcgggcagggacgcgggcgtgggctctgtctctcgccctgcagtgggctgcctgggcactctgcatcatccctgtccctaaaggcacacgtgtgctttaaacacttttacgcagaaatgacaaatttcaaaatgttgaaaggactttttttttttttttttgagacggagtctcactctgtagcccaggctggagtgcagtggcgcgatctcggctcactgcaagctccgcctcccgggttcccgccattctcctgcctcagcctcccgagtagctgggactacaggagcctgccaccacgcccggctaattttttttgtatttttagtacagacggggtttcatggtgttagacaggatggtctcgatctcctgacctcgtgatccgcccacctaggcctcccaaagtgctgggattacaggcgtgagccaccatgcccagcccaaatttcaaaatgttaaaaggacattttcagggttggatgcagtggctcatgcctataatcccagcactttgggaggccagggcgggtggatcacttgaggccaggagtttgagaccagcctggccaacatggggaaaccccatctctactaaaaatacaaaaaaattagccaggtatggtggtgcacacctgtaatcccagctactcgagaggctaaggcacaagaattgcttgaacctgggaggcagaggttgcagtaagctgagatactaccactgcactccagcctgggtgacagagcaagaccctgtctggaaaaaaaaaaaaaaagtaacattttaatgaaagatcctgatactgagggttgcctggccagaggcaccgtcagcaggctaccagctcgtcatctccaggagccctccctgcaccccactcaaaagagaagcaggccaccaggatcacctggcacccaggacacccctcgagggggaccaaccagaaaaacagaccaagacagaaaagagctcaaggtgagaagatgccacactcaggaagacgggagattataaaaaagattcggaaaagacccagagctcttagagatgaaaaacatgaaagaaatgaaacagcctgctggaagctaaagttcaggtgctgtcccaaagcaaaaagatagccacgtgcaaaaaaggatgagataacacatgggttcagtgtggcaggcagagtaacagagaagaagggagacacatctaacgacgaattcaacagaagctcaggacaggaagctgtcagagagcaaaggcctgatgggctcacactgccgtgagatttctgaacgtggagattagaggcaaggagctgaagccccgcagctgcacagcaagggccaggagccagagggccacagaactgcccagtgagaatgctggaggcaaggcgacggcaggggcgcaggctgggaggcagacatgtggccgggcacgccacgcccaccagacacagggcagggagggggaccaccttcagaggggcgcagctcggaaaaggtccctctcccagggagccattgcaggaggcacctcacaagatgaggagggtgtggaccaggaagcggggagtccccagagagcagggaaaagatgcaggtgcacagcaggtgtggacagcacagcacagagcagaggaggctggaaggctctgggctccctgtcaagaggccgaaggcagctcctgacccatgtgtgtgtctgcagatggcagcagtgggcacaggaccagatgcacagagaccagtgcaagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcaggcaccgacagaaccctcgctctgcatgcccaagggctgtgcgaggaaggcaggtgcccagctccccagttcttcgatccagtaaaaggagaccccaaattcagaaagccctggatcaactgaaacagttcttccagtaaggtgtttttctattaaagacaaacaccaagttactgcaactaccaagtcccaatattcgaggggagccaactaagcatcaagatggggccctctgggaggctctcaaaccaaaggatacgcggcgtgccctccgtacggcagaccaggtagaggcaggcagcaatcacgtgggccatcttccggccgcgggtcaggtgcctgctcacggccatcttgaagaagttgaaggcggtgtccaggcagtgctggttcagctgcagctggttccccaggtggtggatgtggcgcctccctaggacacagcacgaggcagctcttagccaaatgttcccacagaacatgaaaagtatcacacggccacagcagcaactttaagaatatagatttgtgcttttccttgtaagtttctgagctcactttttatatgtgggttccaatcactttttatttaaggacactgaaatgtgaattttctgtgatctccatgtgccatgagatcctgttctacctgtttcccttctttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctgggtcagcccacccgtcccttctcagcagggcccattctgctcagccctgcgcccgccagcctctcctctaagagccagccacccggcctgagaaaaagccaggctagcgccatcccctgcacctgcccagagggagggccatggtgtagggaaaaggaagagaggtcagactgttactgtgtctatgcagaaagggaagacataagagactccattttgacctgtgccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagctgcagggacctctgccctggaaagccgggtattgtccacggtttctccccatgtgatagtctgaaatatggcctcgtgggatgagaaagacctgaccgtcccccagcccgacacccgtgaagggtctgtgctgaggtggattggtaaaagaggaaggcctcttgcagttgagatacaggaaggcctctgtctcctgcctgcccctgggaactgaatgtctcgatataaaacccgattgtacacttgttcaattctgagataggagaaaaaccgccctatggcgggagattagacacgttggtagcaatactgccttgttattctttactccgctgagatgtttgggcggagagaaacataaatctggcctatgtgcacatccaggcatagtaccttcccttgaacttaattatgacacagattatttggttcacatgttttcttgctgaccttctccccactatcaccctgctctcctgccgcattcttcttgctgagatagtgaaaataataatcaataaaaactgagggaactcagagaccggtgccggtgcaggtccttggtatgctgagtgccggtcccctggccccactgttctttctctatactttgtctctgtgtcatttcttttctcagtctctcgtcccacctgacgagatatacccacaggtgtggaggggcaggccaccccttcaccatggtaagggcatgcccagcagaccggaggccactgcgccctcctaggggctgcgaggtgctggaggtggccaggacggcaacatccgagcacacgcgcctccctggagcaagaccctcccaaagctgcgggccacatgatggcatcaggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcacggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtcaagcctcacactgccaggcccctggcagtcagcagcatcacatggagcccccagcccggctgtggccctgccaccttgagcacctaaggccacctgcctagagctcatacagctctgaggcctgcagtccagctgagctgacgtggaaggctggtcactgtccccagagctgaggcctgggccaagccaagaccccaaaagaatggacagaaagggcatcgtgccagctgccacctgcacatgtgcagcaccagccagacacaccagcacagaccgtccccgcggcccagcaaggcccagagggaaacagagtcagctgacaggggacccgctgaagctacggctccttacctaccagctctctgctgtatgtttgaaaattctgtaataaaaggtaagagagaggtactctctgaggccacacacttgaggctgggactcgatcccaagccccgaccccacaggcaccagctcgtgttcccagcatgcagggctgctatggtcagaatgtctgactcctaaaattcctatgttgaaatcctatcccctacggggatggtattaagatgcagggcctttgcgggagactaggtcaggaggcagagcactaatgatgagctcagtgcccttaaaaaccggaccccagagaactagcccagctcttctaccacgtgaggccacagtgagaaggagctgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagctgagaggcggccctcactagagagctggggaggaggccacagtgagaaggagccgagaggcggccctcactagagagctggggaggaggccacagtgagaaggagctgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttaccatcttctttctcttttttgagatggagtctcgctctgtcacccaggctagagtgcagtggtgcgatctcagctcactgcaacctctgcttcccgggttcaagtgattctcctgcctcagcctcttgagtagctgggactacaggcacatgccactgcacccagctaattttttgtatttttagtacagacagggtttcacactgttggccaggatggtctcgaactcctgaccttgtgatccacccatctccgcctcccaaagtgctgggatacaagcatgagccactgtgcctggccaaatatgttattaataaacagatattcacatagaaaccaactactaattagctagccatagcctgcgagtctccttagacttccttccaacaaatgaattctaaaagtaaactcaggctgtgtgccgtggctcatgcctgtagtaatcccagcacttcgggaggctgaagcaggtagatcacttgagcccagaagttcaagaccagcctgggcaacatagtgagatccaactgctaaaataatcagccaggtgtggtggtgcaagcctgtaggcccagccaaggtaggaggactgcttgagcttggaaggttgaggctgcagtgagccatgatcctgccactgcagtccagcctgggcagcaagagagcgagaccctgtctccaaaaaaaaaaaaaaagatttgaggcatatcaccacttacatgtaaagtataaagcaataaagcttccagaggaaaacacaagagtatcttcagaccttggagtagataagaatttcttgaacaagtcacaaacagccctaaccataaaaactgatatactgggacttcattataattaagaaatttctggcagggtgcagtggctcacacctgtcatcccagcactttgggaggctgaggtgggaggatcactggagcccaggagttgaagaccaacctggccaacatggtgagacccccatctctatttaaaaaaaaaaaagaattggccgtgcgcagtggctcatgccggtaatcccaacactttgggaggccgaggcgggcagatcacgaggtcaagagatcgagaccatcctgaccaacatggtgaaaccccgtctctactaaaaagtacaaatattagccgggcatggtggtgcacacctgtaatcccagctactcgggaggctaaggcaggagaatcgcttgcacccatgaggcagaggctgcagtgagccgagatcgcgccactgcactccagtctggcaaaagagtgagactccatgtcaaagaaaaaaattaaaaatgagtggatgtggtggcatgtacacgtgatcccaactactcgggaggctgaagtgagagggcggctttagtctgggaggttgaggctgcaaggagcatcgactgcaccactgcactccagcccggaccacagagtgagtgagacccagtctcaaaaaaaaaaattcagaagtttctgttcgtcaaaagacaacattaagagagtgagacaagctacagacgtgggaggaggattcgaaacatgtatatccaacaaaggactcgaatccagaatatataaagaactctacaaatctgtaagaaaaagacaactcagtttttaaaaagcacaaaagacgccaataggcacttcacacagaaaggacgtcccaacagccaagaagcatgagcaaaggttgtggccataattactcaccagggaaagcgaattaatgccgcagcgagtgtgctacacacctaccagaaagactacaactggaaaggctgatgatgccacatgtgaacaaggctgcggagccactgggactctcctacactgcttcctggtgggaacatgaactggtacaagcactacagaaaaccctgtggccctatctaatgatgagcacacccagacctcaggacccagacacccattcgcaggtaaactcccaagcggagggggcacctgtgtccaccgaaggaccaggtgcaagaacacgcacagcagcttcctgtgcacagccaagaatggaaacaccctagacgtccatcaacaggaaaaggagataaactgtggtctattcatcccatgaaatactacattgcaataaaagaataaactacttacacgctccaaaacagcacgttctagaacggctccagcccagacactggcaagccagatgcggacgactagagccacaggagctctccttccttgctgctgggagcacaaaatggctcaggtgctttggaaaagggtttggcagtttcttacaaaactcagcatactctcaccacaccacccagcaatcactcagaaaaacctgcacgtgacgtttacagcagcttcactcataatcgcccaagcccagattcccttcagcaagcaggtgaaaggataaatcaactgtggcgcacctaggcggtggaatattactcaccactaaagagaaagaggccacaggctgtgcagagacctggaggacagttaaatgcccatggctgagtgacaggctgcacagagaaaggatgcacagtgtgcaactccagctctacgaccacatgaccaagcgccggtgaaaagatcaatggttgctggaggctggggaaggagggatgaatgggtggagctcaggggatctttaggactctgaaagcactctgtatgaaactgtaacagtggttacccgtcactacgcattcatctaaacccatagaacacgcaccgcccagcgtgagcctgggtgtgtggtggaagctgcgtgatcctgagcccaggtgtgcagatacagcctgaatgatcctgagcccgcgtgcgcaggtggaggctgcatgatcctgagcccgcgtgtgcaggtggaggctgtgtgatcctgagcctgcgtgtgcaggtggaggctgcatgatcctgagcccggctgtgcggtgaaggctgcgtgatcctgagtccgggtgtgcggatacagcccgcgtgaccctgagcccgggtgtgcggatatagcccacgtgaccctgagcctgggtgtgcaggtggaggctgcataatcttgagcccaggtgtgcaggtggaggctgcatgaccctgagcccgggtgtgtggatacagcccacgtgaccctgagcccaggtgtgcggatacagcctgcgtgaccctgagcccaggtgtgtggacagagcctgcgtgaccctgagcccaggtgtgtggacagagcctgcgtgaccctgagcccgggtgtgtggatacagcctgcgtgaccctgagcccaggtgtgtggatacagcctgcgtgaccctgagcccaggtgtgcggatacagcctgcgtgaccctgagcccaggtgtgtggatacagcctgcgtgaccctgagcccgggtgtgtggatacaggctgcgtgatcctgagcccaggtgtgcaggtggaggccgtgtgatcctgagcccgggtgtgtggatacagcctgcgtgatcctgagcccgggtgtgtggatacagcctgcgtgaccctgagcccgggtgtgtggatacagcctgtgtgatcctgagcccgggtgtgtggatacagcctgcgtgatcctgagcccaggtgtgcggatacagcctgtgtgaccctgagcccgggtgtgtggatacaggctgcgtgatcctgagcccaggtgtgaggtggaggccgtgtgatcctgagcccgggtgtgtggatacagcctgcgtgaccctgagcccaggtgtgcggatacagcctgcgtgaccctgagcccgggtgtgtggacagagcctgcgtgatcctgagcccgggtgtgtggacagagcctgcgtgatcctgatgagtcgatgtggggcggctgactgcagctcgtgcaccacagtggaggggggcactgacggggtcaggggaagctgtgtggtgggaggtgctcagagtctacaggaactctctgccgatccattttgctgtgaacctaaaatgctctaaaaattacaagtcttttttttttttttaaattcctttctatatgattcccactgtatgaagcagaaaaccaagtgaagccagtgggcagcaggtgctttctgagctgctgcaggcctgactcatgtggatttgtcaggtggttcatggaaggtcagcacatttcatgcactttactatgcgtgctatactaggaaaaacagaccaagagaacagaaaaagaatttccctgagaaacgcgtcccaaacgaaaggctcatcaggtcaatgaagagagccccacctagcggcatttcagaaccgtcgcttcagaacatcaaagaaatcatcccaaaaggcctgagattttaaaaacagagatcaaaacacactggcattcaacgtctcttgctggtggacccggagcagatgctccccacattccatggggtgcctgtctcaaccccttggcaaccatcccagggggaaggggcaggagtttctctctcccagaccctttctctaaatacagtctcagcgtgtccccagcaaaccaaaggaggggcctgtgacctcgcagggtgcacggaggcaagcagaggagacagagtcctcgcagaacatgactgtcgctgcgggcaggaagggtggcccgtgagtttatttccatctttgcagttttctaagaaaggcaatcaagacttcaccaaaacagtaacagtcggaagctacattcacagatttccaccaaacctggcaggctgggtggcgggcgggagtggaggccgtgggccaagcttgcagcgggaccagggctgatatgaaaacttcaaccaaggcggtatggggagaacaaaggagaataaacaaaatttaaacaaacataacccatgataaatcaatcaatcaaaataaagggttttttaaaagtaagataaatacagccaggtgtagtggctcacacctctaattcaagcactttgggaggccaaggcgggtggatcacctgaggtcaggagttcgagataagcctggccaacatggcaaaaccacgtctctactaaaaatacaaaaattagccgggcgtgatggtgggcacttgtaactccagctactcgggaggctgaggcaggagagtagcttgaacccaggaggcggaggttgcagtgagcccagatcgcgccactgcactccagcctgggtgacagagcgagactccatctcaaaaaacaaacaaacaaacaaaaggtaagataaatacgaaatacaaaataagaggcaggaagagcccaaagcatcagaaatgtgccagttataatgggccaaaatcccctcttgtgtctccagaagtatttgaaaaatacgttaggatctgcctcacagacatgctcccaggacactcgacagcaaggaggtacggcgggcccagccagccaaggcagaggaggacatcactgccacagcagggggcctgactggcagcaaaagggacgactccggcgaaaagtcagcaggaaacaggacaggggctggaccaatggcctccctcagccccacaccccacccaggcaggagcggtgcctggcccggggcaggcgggtgggagagctcactgagtgggcagcagggcatggcccctgatgctgcaggtacccaggctgcagctgcagaacctcaggtgggaacccaggtacaaagatcagcatagggtcccccagaaccacccatccccagtaagactcaagaggggtgggggccccgcagcttcccccacacagtgagtggggtccacggggcctcctgggcctgcaggtcacaaccttcactgacactcacccctaattagggagcatgtatgttccaattttcatttctttcttgaaccaaaggtatttaaaaggcttttgaaaaggtaagatgagccatttctctttctctgttgttggtttccaatcctattgcaatgcacgcgtctgcaccgacactactctttgcaatttgtataggtctgaggcacgaccaactctagtaaagataccgcgagtttttgggaaaatacagactacattctctgtggagaacaaagctcttcacatggagaaaatcttgaagtcagtagaagaaaaaaaggagatagcctagtggcaccacaagcaatgggcagagctgggccccaacccaggcagcctgaggtcaggagggcccctgggcagcgcagccccagcccccacctggaggaactgtaaacgtgtgtgccaggaagccctgaaacagacaaaacaaaaaactgacaaaactgtgggtaggacaggacggatccagtcactgtgccaggtcttcatgcacactctcggtggcagacacagagaaccagccagtggagaggaagagggatgtgctgcgctgcacccgcttcctgcaggaaacgcattcaagcgcccaacacacatgcacgtccacaaaactggccttccacccggccacggctcgaagcatttccgaagactgaaatcacacagagggtgctctctactgcagaagaatcacaccggcagtcaggaagaaaggcgctgactatactcctctactagtaagtccacagcaggacaaggaaaaaagcacaagggaagcgtaaggatccatccactctgctgtgagggatcatcgcaagcccaactacccctgccagcctaggtgtgtcggtgctggccacccgtcggcagcagcagccaggagcagaggcaggtgctcaagagcccggcctcctggagatggcccaggagaaaacagccagggtgacgtgctgtccacaagagatgttctacctgtcccgaccaccttccagcatccacactaaggctgcaggacatggctgcaccgatcacaagaatccctcacgtggtcctcaggttcctgagagtgtactcaatgaaacagtgaagccaaagagatcctagcacaaagtatccctgcctggactgacccacggccaacccacactcaatggtgaagactggatgcttccccaggatcaaggacaagaggatgtctgttcacaccactgctattcaatgtggtaaacaaaaaaaacaaaaacaaaaaacaggcactagactagaaaggaaagataacacgatcttgtaccgaaaatcctaagtgatccgctaaaaaactattcagcataaaaaatgagttcagccaggctgcaagatacaagatcaatacatatcaactgagactaaattcgacaaaagaagtacaaaacttatactctgagaactaataaaattgttgaaacaaattaaagaagacccaaataaatggaaagaaatcctgtattcaggtatcagaagactttacactgtttaggcggcagtgttccccaaaatgaccaacatattaacgcaatccccgtcaaaatcccagctgacttcttggcagaaactgacaagctgatcctaaaattcatattgccactcaagggacttcaaacaggcagcataacacttttgaaagagagcagttagaggactcacagttcctgatttcaaaactgactgcgaagcttcagtgtcctgaacagcgtggaacgggcaccaggactgtcatgcagtcactaagccaaactgaggatccagaaatgagcttttaggtttacggtcaatcgattttcagcaagggcaccaagaggatgccaactggcaaaatacagtgttttcaacacatggtcctgagaaaactgggtctgcacgtgcaggagtgaaggcaggcccttaccttacatcacatgcaaacgctgactcaatatggaccaaaacctactggaaagagaggaaggcgcaaaactccaaaaaatcataagcacaaatcttcacgatttggactggattaggcaacatttgttagttatgataccaaaagcacagccatcaagagactaaataggtaaactggatactatcagaatttaaaactttcatgctccaaaggataccagcgaaaaataaaaagacaaaagaaaatgaaaagaacgcatgaaatggctgaaaatgtcctataaatcacacatccgataaaagacttgtacctaaaacacataaaatcacacatccgataaacgacttgcacctaaaatatataaaatcacacatccgataaaagacttgtacctaaaacacataaagaactttttcaactcaatcataagacaaataacccagcagacatttctccagtttgtggtgaactggcactttgacaaaacgcagtgagaatgtcactacaatatccaactgctataaatgtgttatttctgcctccatctcactgaggccatcaagcaatggctgtggatcctgtgggatccactgggttctccccaaacagccctggcagagtctgcaggacacccaggaggggactcagggcacaattcctcctggaaagcagcctgggctgggcgtgcagggtgacgaggaagtggcaggccatgaggtccatggctgagtcagtgccctccaccctagcaccaccatccccatctctgggacccgccgcacgctcagcagcatccgcggtgggaaataccattctgcagggtctgcgctctcgactccttccccagattcacgtggaagccgccacccagagtcggggttttgccagcacctggaaacacaaaaaaagacagatcagccaaaacttggagatctgcatttacaaccctttcctaacatccacagacacaaagtgagaacaaagcgggggtcagcactcatgggggaagcagcaggtcggccccccgcacctccgtcactgagccaggaaccccagtgggggaagcatctctcactctgcccagccagcagggttgagggtgggccaactgcactttccgcattttctttttttttttgagacggagtctccctctgttgcccaggctggagtgcagtggtcccatctccactcactgcaagctccgcctcctgggttcacgccattctcctgcctcagccttccaagtagctgggactataggtgcccgccaccacgcccggctgggattacaggcactttctgcattttctaaccatgtccctaacacactgcaagtccagagtggacgctgtcaaatggctgccgggcgagaacacagatgtacctccaaacctctgcaagtggtgcacacacagcatgggctggccgtcccccttgccccaggccagcccactcagatatcactcctgcatggtgaccacatgtgaacacatccacctccctgctggactgcaggggacgcaggtaccatcccatgtgccccaaggcactgcaaccagccagtctgcagaaggcccccacgcctcagtccacccacccatggggaggctgcagctgaacctgctggacactctactccgaagctctgccaactgacagcatgcctacgacgtccaccacattctgccctgcagggcttcggggttaagacctggccctggtacctctggaaacatcaggtggacatttggattgttcaccaggttcaccagcccgatcgctgcagcctgatctcccaatgagcatggtggacatgtggattgttcaccaggttcaccaacccaaacgctgcggcctgatcttccaacgagaacagtaaggtgaggccccaggcatgcccaaagatggggagagctggaaagtgccccccgccccgcagcgtcggccctcagtggttggcacaggggccagtgcatttgtgacaaagcacagacacaggactggaggctgctgcaatcgggacgcgcagacaaccttggccacttgggggaaggcaagtgtgtagggcctgtcggaggacactggaaggataggatgcagaagcagaaagccaatcgctggagcctggggccaggccctccagggaaaccatgaggcagggacctcagcgtcatccaggggcagccaccagcacagacaaggcagaacaggcacggcctctggcttcacaatgaatgtaactgaatcccaaacaaatactaacaacactctttaaagactccagtaaaatgattctaaagttcagttggaagcaaaaaggaattagagcagccaagaaaagttttgaagagagcaaggggcagctactgggcccgtccggaaactcagagctgaacagggtcaggtggcactcagcttttcctggtggcagcagaggcaaagcccgggcctccttcaggctgaggcccagagccggcctcctggtgggtaacgtggccacaggggtggccggcagcagcagcagggcaccagcactgagcacaggcctccaacaaaggtggtgccgggacgggggcagtgcctggagactacctaggttgtcacaactgggatctatgtactagttttctgtggctgccataaaaattgccacaaacctagtggctttcaagaagctgtagaaggtccgggcgcggtggctcacgcttgtaatcccggcactttgggaggccgaggtgggtggatcacgaggtcaggagatcgagaccatcttggcgaacatggtgaaactctgtctctactaaaaatacaaaattagccaggcgtggtggcgggtgcctgtgatcccagctactcaggaggctgaggcaggagaatcgcttgaacccaggaggtggaggttgcagtgagcagagatggtgccactgcactccagcctgggtgacagagcaagactccgtctcaaaaaaataaaaataaaaataaaaataaaataaagtaaaaaagaagctggagtggtggccgggcatggtggctcacacctgtggtcccaacactttgggaggccggagcaggaagatcgcccaacccaggagttcaataccagcctgggcaacacggggagacccatttctttctttctttctttcttttttttttttttgaaacagagtttcgctctgtcacccaggctggagtgcagtggcgtgatcttggctcactgcaagctctgcctcctgggttcatgccattctcctgcctcagcctcccgagtagctgggactacaggtgcctgcaaccacgcccggctaattttttgtgtttttagtagagacggggtttcactgtgttagccaggatggggggagacccatttctacaaaaaaaaactgaaaaaaattagctgggtgtggtggcacctgcttgtggtcctactactcaggaggctgaggttggaggatcactagagcccgggaggtcgaggctgcaatgagctgagatcgtgccactgcactccagcctgggtgacagagcaagaccctgtctcaaaaaaaaaaaaaaaaagaagctagaacaggccaggcatagtggctcacatctgtaatcacagcactttgagaggctgaggcaggaagactgcttgagcccaggagttcaagaccagcctggacaacatagcaagatcccatctctacaaaaaaaaaatgagcggggtatggtagggcatgcctgtggtcccagctactcaggtggctgaggcaggcagatcgtttgagtccagaaggtggaggctgcagtgagctgtgatgcacctctgcactccagcctgagcaacacggtgagaacctgtctgaacaaataataaactaaacagaagctggagcaggtcgcagtggtgtctccttgtgggggctggagaggacctggcagggccacagtgaggtgcctgctgatatgagaatccagaagagaggccagggagaaacgcaggactcaggagagacccatcctggaataagggggctttgagcagcactgatgagccaattctaaattctgcagaaatctggcccaggcctccccaggctgagctccaggtgcctgcaactccgaccctccctcagagttctttgttttgtgagcagtgtgtattctttttttttttgagacggagtctcgctctatcgcccaggctggagtgtagtggtgcgatctcggctcactgcaacctccgcctcccggattcaagcaattctcctgcttcagcctcctgagtagctggaactacaggtgcgtgccaccacgcccagctgatttttgtatttttactagagatgaggtttcaccacgttggccaggctggccttgaattcccgacctcaagtgatccacccacctcggcctcccaaagtgctgggattacaggcgtgagccaccacgccccgcctgttttttctaagcgttcgaattaagatcaccattctgtgtagcccctggcatgctggtctccagcacatgctccctcaccaactttcactttagaaaaagaaaaatctcactatattctaattagtgtatataatgcttttaataaataactcatataacactacattagaaaaaggacaatgatcaaagtataaaaagccagctgggtgcagtggctcacgcctataaccccagcactttgggaggccgatgcggttggatcacctgaggttgggagttcgagaccagcctaaccaacaaggagaaaccccgtgtctactaaaaatatgaaattacccaggcatggtggcacatgcctgtaatcccagctactcaggaggctgaagcgggagaatcacttgaacctgggaggcagaggttgtggtgagccgagatcgcgccattgcactccagcctgggcaacaagagcgaaactccatctcaaaaacaaataaataaaaagcccctgaagccccaccttccaagaacaggggacgccgtacagcctccattatagccacgtttccctgcctaggtacagtgggctgcaggcgtgcttctgacagaacagggccacagtgagatgccacgttaaattacagtgatgatttcgattctggttgtgttttacgcaatctcttcactccttgacccatacccatcagcttgcaccacagcacactgcaaagctgcatgcgtcagcagctccacgctccacctgccacctctgccctccctcctccatcactctgtcttgcaccctccagcctcccataccctcctcacaccccaggacctctgtttcctgtccctgtgttgttctccctgtcccccaacaccacagtcaccctccctggggccacgctgctgcacctgctctggaagcgcctcctggcttctgcttgcctcacaccctggtgcgtgcacacttgcaggcacacacacacaggacacatgtggacagtgtgaaacctcagaacactaacccacagggaggatgaaagaggaaagtgccacctctggctgaaactgccaggatgccctctacttctaaaaacatttggtattttccatagcgtgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccgacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaaattagccaggcatggtggtgtgctcctgtagtcccagctactcgggaggctgaggcaggagaactgcttgaacccaggagatggaggttgcagtgagccaagactctgtcaaaaaaaaatttttttttaactggagactttctgttgctgctgtgaaacttcctttttttaagagacagggtctggccgggcgtggtggctcacgcctgtaatcccagcaccttcggaggccaaggcgggtggatcacctgaggtcaggagtttgagaccagcctggccaacatggcgaaaccccgtctctactaaaaacacaaaaattagccgggcatggtggcacatgcctgtaataccagctacttgggaggctgaggcaggaaaatcgcttgaacccgggaggcggaggctgcagtgagatgagattgcgccattgcactccagcctgggcaacaagagagacactccatctcaaaaagaaaaaaaaagaagtctcactctgtcacccaggctaaagcgcaggggcaccatcacggctcactgcagcctcaacctctcggactcaaggaatcctcccacctcagcctcccaaataggcgggaccacagacatgcgccaccacgcctagctaatgttttcttattttttgttttctttgtttgtttttttgaagacaagacagagtttcgctcctgtcgcccaggctggagtgtaatggcacgatcttggctcactgcaacctccacctcccgggttcaagcgattctcatgcctcagtctcccaagtagctgggattacaggcgcccaccaccatgcccagctaatttttgtattttggggttttttcttgttttgtttttttagtttttgtagagacagtttcactatgttgcccacgctggtctcaaactcttgacctcaagtgatcctcccaccttggtttcccaaaatcctgggattacaagcatgagctaccaaacctgactggaaacttcttttaaggggagacacctgtaggaggcctggctggctgggcagtaatggatggagaggaattcaggggtcccacaggtgagtgcccaaaggaggctggaccagaccgcagtgcatccctgagagctggggacggggacccgggaacacagagcgtgtgcctactggtggggctggatgcagtagcatcagacatctgggaggagcactgacaaacagggccaagcacggcagcccacaccccttcccaggcgcagacccttcccatgcgcacaccccttcccaggcacagacccttcccaggagcaaccctttcccaggcccacaccccttccccaggcccacatcccctccccaggtccagaccccttcccaagcccaggccccttccccaggccactgcggaggagctggttttgtagtgattacaatttggttacggaaaacaggacgtgtgtcacgctgcaggctaaccagcagcttcctccctcacccagatggcaacgggacagaattcacccgtttcctaagagcaggcaccttcagccacaacttagggttctgggggtcatggagcagaggcagaagcctggagccttccaccctcaggactagagccccgccaggaggccaggcgcatgctcagaaccccaggccgcagggagaggctggccggtcacatccttctctgaggcagagggagcttcccagcaggcgagggcaactccaccacccatgtccccctccagggccagcgccaggtgacatgcagccatgtcacaaattaggtccggctgcatcgtgaccccaaacggaaaacagcagcactcacggacaccccagcttcgaagttctaactgtgaagccactgaaagttgtgattacgggaaacgctccccacccccacaagttctggtgacactgaggtgtgctgctccttgcacaggacgaggagggacccctgcaagcaggagcccaggatgtctggtgtgtgggcgccatcaccatcacctgctggcagagggaagcctcagggcacacacagtgcaggacactgatgtgggctcacagggaagccccgccttgcctcagtggagcagacggcctcctcagggcactgccaacggcccccaactccaccgtctgcctggcccctccagccacgctgagcctcagtcctcacccacccttctctctgcacagtctctgctcgggtgccccgggacgctggagcaccagtgtggtttcccccgtggggcctggcttccaaggtcaggaccctctggggactctcctgaggcctctggtcacctgccctgatgccttagttaaatattccagagtaaactgcgaagctgtatcaggcttagttctcaattaataggcaaaacacctaggaaagacagtggccttgggactagaaaacgacagctcagagagaaagctcagctttcaagatgaagctggaggaaggggcggctggggcctacttgtgtgccagggaaactgagaagccaccaaggtttccagccccctgtgatcaccactgtgacgagggaggaaggatgccaagtgggcacctagagagcctgcctgggagacagaggggctgcccagagcaacagatcccctctctcctccccactctcggcccaggcaccacctgcgccggtccccaggggctaagaacccgccgcctcgcagcacttcccccaggaccaccacagttggttgctgggcctgcgcctccctccagagagtgtgcctgggctcagaggcgtcttggggccacctgacagcgctggctctgagcttgttctgacagcacccgggtgacagacttccagctctgcactgctccacaccaccatcctcccccggcagggcacagtgagggcagtgcgctgtcaccaggcccggatgcacttaacactgtgcctgcccgggaaaccctgcgtctgctgccatgacaacttgctttcattactgttgttatcatcccaacagacatccaagtcttggcaactgtgacacagctgcaaactctgtgcccagcagtcctaggaagatacccagggagtatgagcatggaagacgatggggagggaagagcaggagagaaaactcaatgaagcccaagccagttcttagaaaagatcaaaaacacggatcaacttctagcaagagagacaaagggaaaaaaagacacaaaacaccaacatctgaaaggaaaaaggaggccactgtggaccccgcagatatcaaaaggataagggaatgcttcgaacaactctctgggcaaattcaacaactaggtcaagtggaccaattcctcaacacaagcggctaattcaccccaggtgaaacacagcatcttaaatataactagaacctcagtgatgaaagaagccgaaaccacagtgcagaatcttctgagaaagaaagctttgggaccagatggctacgctggtgaattctaccaaacatttcagaaagaaagaacaccaactctacataatgtcttccagaaaatagaagaggaaacgtttcccaacccattccataaggagcagaaccctgatacccaagacaaggacgttacaggaaaaactacaggccaatatcccacgcaagcatcagcaggaaccctcaacagaacatccggcgctgagcaaagcagctcatgccgctaatcccagcactctgggaggccaaggtgggaggatgccttgaggtcagaagttcgagaccagcctgagcagcaaagcaagaccacatctctacaaaaaaaaaaaaaaaaaaaaaaaaattggcgttggctcacacctgtcatcctagaactttgagaggccaagacgggagaattacttgagcccaggagttccagacgagcctggtcaacatggcaaaaccccatctctacaagaaaaatacaaaaattagctgggtatagtagggcgcacctgtagtaccagcaactcaggaggctgagctgggagggtcactggagcccagggggttacgactgcagtaagccatgaccactgcactccagccagggtgactgagcaagaccctagaccctgtctccccaaccaaaaaaaaatttttttaattagctgggcatggtagtgcatgcccgtagtcctagctactctggagtctcaggtggaaggatctcttgaacccagaagttccaggctgcagtgacctgtgatcacaccactgcactccagtctgggcaacagtgagactttgtcccagaaaaaaaaaaaaaagctgggtgcggtggctcacgcctgtaatcccagaactttcaggggccaaggcaggtgtatcacttgagattagaagttcaagaccagcctcaccaacatggtgaaaccccatctctactacaaatacaaaaaccagccgggtatggtagtgggctcctatgtaatcccagctactcaggaggctgaggcaggagaatcgcttgaacccaggagggggaggttgcagtgagcccagattgcgccactgcactccagcctgggcaacagagcgacactctatctcaaaaaaaaaaaaaaaaaaaaaactcaaggagtgtattaaaaactcttaggggccaggtgtggtggctcacacctgtaatcccagcactttgggaggccaaggcgggtggatcgcctggccaacatggcaaaaccccatctctactaaaaatacaaaaactgcggccgggtgcaacagctcacacctgtaatcccaggactttgggaggccgaggtgggcggatcacgaggtcaggagattgagaccatccatgtaaccccgcctctgctaaaaatacaaaaaattagccgggcgtggtgctgggcgcctgtaatcccagctacttgggaggctcaggcaggagaatggcatgaacctgggaggcagagcttacagtgagccgagattgtgccactggactccagcctgggtgacagagcaagacgccgtctcaaaaaaaaaaacaaaaaacttagctgggtgcggtggcgggtgcctgtgatcccagctacttgggaggctgaggcaggagaatctcttgaacctgggaggcggagattgcagtgagccaagatggtgccactgcactccagcctgggcaacaagagcaagacaccagctcaaaaaaaaagaaaaaaaaaaaaaaacctcttagaacaagtaagtttagcaaagccataggaaacaggacaacacacagaaatcaaccatatttatataaacaagcaatgaagagttgaaaactaaattaaaaaaattccacttataataactcctaatagagcttaggtacacatctaaaaaatgtccagagggccaggcacggcagctcatgcctataattccagcactttgagaggctgaagtggggggggatcacttgaggtcaggagttcgagaccagcctggccaacatggtgaaaccctgtctctactaaaaatacaaaaattagccaggcgtggtggtgggctcctgtaatcacagctacttgggaggctgaggcacgagaatcgcttgaacccaagaggcagaggttgcagtgagccgaggttgcaccactgcactccagcctgagtgacagagcgagactccatctcaaaaaaaaagtccagaagctgtatgctgaaaactacccaacactgacagactatatcaaagaaaatctaaatgaatgcaaacatacactgtgttccatggactacaagattcaacatagaaaaaatgtcagctgggcacagtggctcccacctgtaatcccagcactttgggaggccgaagagggcggatcacgaggtcaggagttcgagaccagcctggccaatgtggtgaaaccccgtctctactaaaaaatatacaaaaattagctgggtgtggtggcgtgtgcctgcagtcccagctactcagaaggctgaggcagcagaatcacttgaactcgggaggcggagggtgcagtgagctcagatcgcgccactgcacttcagcgtgggtgacagggtgagactctgtctcaaaaaaagagaaagaaagaaaaaatgtcagctctccctaaatatatcaagaggtttaatgcaattccaatgaaaaccccaccaggacttttgtacaggttgaacatcccaaatccaaaaatctgagattataaatgctccaaaacggcccggtgcagtggctcacgctggtaaacccagcactttgggaggctgaggcaggtggatcacgaggtcaggagatcgaaaccatcccggctaacacggtgaaaccccgtctctactaaaaatacaaaaaattagccgggcgtggtggcggtcgcctgtagtcccagctacttgggaggctgaggcaggagaatggcgtgaagccaggaggcggagcttgcagtgagccgagatagtgccactgcactccagcatgggcagcaaagcgagactccgtctcaagaaaaaaataaaataaaaaataaatgctccaaaacatgaaactttttgagtatcaacacgatgctcaaaggaaatgctcactggagcatctcagatttcagatttttcgattagggatgcttaaccagtaattataatgcagatattccaaaatcagaaaactctggtatccaaaacacttctggtcccaagcatttcaggtaagaatatgtgacctgcagagatgcacaaacttactctaaaattaaaaagagaaagggaaattaatagccacaacaactttgaaaaggaagaacaaaggttgagggactcacaatatctgatttcaggacaatataacaggtatagtaaaaaagcgtgtgatgctgacaaaggaaaacggcacctgatcaacagggcaggacacaaggcccagagacagacctgcacggacggggcccagtgagcacagccgagggagcaaaggccttcagtctttcaacaaacggtgttgaaacaaggggacctccagataaacaatgagcctcagcctacaaagcacaccttatacaaaacatagatggaccacagatttaggccaggtgcggtggctcgcgcctgtaatcccagcactttgggaggctgaggcaggcggatcacttgaggtcaggtgttcaagaccagcctgacgaacagggtgaaaccctgtctctactaaaaatacaaaaattagccaagtgaggtggcgcacgcctgtaatcccaggtacttgggaggctgaggcacgagaatcacttgaacctgggaggcagaggttgcagtgaaacgagattgtgccactgcactccagcctgggccacagagcaagattctgtctcaaaaaaaaaaaaaaagttaaaacttctgctttgaggccgtgcgcagtggctcacgcctgtaatcccagcactttgggaggccgaggtaggcggatcacgaggtcaggagatcgagaccatcctggctatcacagtgaaaccccgtctccactaaaaaatacaaaaaaaattagccgggcatggtagtgggctcctgtagtcccagctactcgggaggctgaggcaggagaatggcgtgagcctgggaggcagagcttgcagtgagccgagatcgagccactgcactccagcctgggcaacagagcaagactccatctcaaaagaaaaaaaacttctgctttgaaaatcacatatacaacaaagggcttgtaactacaatccacaaagaactcccaaaactcaacaataagaaaacaacccaaataaaaaatgagagtcagggtgtggtggctcacgctgtaatcccagcaattcgggaggccaaggctggagtatcacttgagcccaggagtttgagaccagcctgggcaacatagagaccttgtctctactaaaaataaaataaaataaatgatcacagcatggtggcatgcacctgtagtctcagctactcaggaggttgaggcaggagaattgcctgagcctaggagttcaaggctgcagagagccatgactgggccattgcacaccagcctgggccacagagtgagatcctgtctcgagataaataaaaaaataagacttgagcacacatttcaacaaagaggattcgggcatggcaaataagcaccctaataaggttgaacatcactagccagtagagaaatacagaataccactatgatgagatgccacacacctgttagaacaaccgaaataaaaacatcgacaacaccaagtgctggtgaagatgtggggcaactggtgagaatgcataatggcacagccacatcacaaaacagttcatgacagtttcccatagagttacacatacagctaagttccccagagaaatgaaaacgtatgttcacacagagagctgcaaatgaatccttttagcagctctattcacaaccacctgaaactggccacagtccagctccttccacaggctggggtccatccccagcccgcaatactgcccatcactgaaacgtcccctccgaggcctgcagcagcctgagtggccctagggcatccgcccggtaaccaccaaggccaagggcagcagcaatcggattctaagtaccagacattgctgaaaacaaaactgcaggcacagagagtgacagtgaggggcagcttgaggggccttctgggctccccaggctctcttcaaccctccctgtgctggctgccctggcccacgcgtgtgtcgaggaagtccacgcacgccacgggggtccacaggcgcgcgaagaaggtctacattctcgccaaggggatccacactcgcgcccagacggcgcagaaccgcgcgccccgacagagcgtgcggtaccgaggcgctggtcccggccgcgccgtcaccgcctccagcccgcctaagccgcaccgagaaatccgcgcagcgccagcccgcgggactcaccgtccagggacacgaactggcccacggccgaggagccgccgccgctgctctccacgaactgcacctcggacacgatgatgttgtcctccagcactgagccgcaggcggtgcacaccgcgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccgaggactggcgcttgggggcggggccacggcggtgagcgcagcccgggactggagtttggggcggggcctcgtcggtgggcgacaccggggactagagctaagggtggggcctcgcggtgagtgcagccggggacgggacccaaggctggcgacgggacccaaggctggcgacgcgacctaaggcagtgggcgggcccttggcgatgaacgcagtcggggactaaagctggacgcggggcagaggagggtcctcctcggatagtgagcgcggtctccagcggcgagcgaggcctggggtgaggactcagccggatgcggggctgagggtggggggcggggcctcccgtggagagacggcctgcgaagggaactggagctgtgggcgggggaagggggcggagcctgggtctggacccgaactgtgggcggggcttgaggcgagggggccgagcgtggtgggcggggccttggctcctgagggcgacctgggacccaaccccgggctctgggagtggtgggcggggccagggcagctgcgctggggggcctggccgcagaggtggagacacccgccaggggccaccctgccccgccctccgcatttgcggcgtccgccgctccgctcgcccaggttccagagcctccccgtgcgccccgctattctccgttttctgttcccctaaaattcccactttctagcagtcattcgtggccacctgtggttacccgtgagtcacctcgctgtgccccctgcccagagcgggaaccctggctgcgcacgccctcaaatatctgcaggtgctgttcacaatcgccatagggccggtgacatacccaggaatgagcctaaaaagaaatgcgtaaccaggcgtagtggctcacgcttgtaatcccagcactttgggaggccaaggcaggcggatcacgtaaggtgaggagttcgagaccagcctggccaacatggcgaaaccccgtctccactaaaaatacaaaaaaattagccaggcttggtggtgggcgcctgtaatcccagctactcgcgagtctgagacaggagaaccacttgaacctgagaggtggaggttgcagtgagctgagatcccgccattgcactccagcctgggtgacgggtgacaagagtgaaactctgtctcaaaaaaaaaaaagagaaaaaaggaaatgcggaagaccccaccctcttttttttctttcttttttttttttttttgagacggagtctctgctctgttgcccaggctggagtgcagtggtgagatatcggctcactgcaacctctgcctcctgggtttaagcgattctcctctctcagcctcccgagtagctgggattacaggtatgcaccaccacacctggctaattttgtatttttagtagagacggggtttctccatgttggtcaggccagtcttgaactcccgacctcaggtgatccgcccacttcagcctcccaaagtgctgggattacaggcatgagccaccgtgcatggccctatttcattaatttctgctctcatttttgttagatccttctttccacttaatttggttcaatgtgttccctttttctagtttcttcattttttaaaaattgagatagtgtctcattctgtcacccaaggtggagtgcagtagcataatcaagcctcactgcagactctacctcctgggctcaggtgatcctcccacctcagcctcccgagtagctggaactacaggcatgtgccaccacacccagataatattttttgtagagatgggtttttgcctcatttgcccaggctggtctggaactcctgggctcaagtgagccacccgccttgtcttcccaaagtgctgggattacaggcatgagccactgctccccgccctgtcctcccaaagtgctgggattacaggcatgagccactgctccccgccctttctctagttcttttttttttttgagatagagaacacccaggctggagttcagtggtgccatctcagctcactgcaacttccacctcccaggttcaagtgattctgtcacttcagcctcccaagtagctggaattacaggcatgtgccaccacgcccagctaatttttgtatttttagtagagatggggtttcaccatgttggctaggctggtcccaaactcctgacctcaagtgatccacctgtcttggtctcccaaagtgttgagattctacacgtgagccaatgcacccggcccctttttctagtttttgttttgttttgttttttgaggtggagtctcgctctgtcacccaggctggaatgcagtggtgcgatcttggctcactgtaacctccacctcccgggttcatgccattctcctgcctcagcctcccaagtagctgggactacaggtgcccaccaccatgcctggctaattttttgtatttttagtagagacagggtttcactgtgttagccaggatggtcttgatctcctgacctcgtgatccacctgtctcgccctcccaaagtgctgggactatgggcgtgagccatcgcgcctggccttttcctagttttttaaggtgaaagatgaaatcattgatttaagatctcttttcctttataaataggcattttattgctataattctccctgtaattaccactttagctgaatcctgcacatttcaatgtgctgtgttttcattttcattcagctcaagattgtctccactcttaatttcctcccggatccaagggttattaggaagtgtattgttttgtttctaaatgttggggatttttcaaatatgtattattgatctctatgcaaaatgctctctgtccatgatgacatttcatccttatggcaacactagcttgcagacactgttgtctccattttatggagggagcccttgaggatgtgaggggtgacagccccaaatctcatagccagtaggtaacaaagccagaatccaatctgaggccatgtggccactggatccttgctctcacctgacagactagaggggttatttcgtgtgctccctcaccaaagcctgtgaggtgcctgcaggtgcaaggggcagcatgcctcccaggccacagcggtgcaggacagtcaggcagtacaggacagtcaggctgtacaggacaggattggccagaggagcagagggtggggaagaccacacccacaacggtaagaggtttaaagggtgtggtttcagccaggctcggtggctcaggactgtaatcccagcactttgggaggctgaggagggcagatcacgaggtcaagagatcaagaccgtcctggccaacatggtgaaacccatctttccaaaaaatacaaaaattagcaggtgtgatggtgggcgcctgtagttccagctactcgggaggctgaggcaggagaattgcttgaacctgggaggcgggagttgtggtgaggcgagatggcgtcattgcacttcagcctggacgacaagagtgaaactccatctcacaataaataaaataaaataaaataaaatataaaaaagggtgaggctctactgggcaatggcccaaggtgcgtgctgccagaactaagcctttgctcagatgggctgcagaggaggggtgctatggtctgaatgtgcattgtatcagtctgttttcacactgctgataaagacatacgtgagactgggcgattaacaaacaaaagaggtttattggacctgtagttccacgtggctgcagaggcctcacaatcatggaggaaggcaaggaggagcaagtcacgtcttacgtggatggcagcagggagagagagagcttctgcagggaaactccctcttataaaaccgtcagatctcgtgagacttattcgcaatcacaagaacagcacgggaaagacctgcccccatgattcaattccctcccaccaggtccctccacaatatgtgggaattcaagatgagatctgggtgggtacacagagccaaatcatatcatgtgtgttcccccaaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaagaaacaagaaaaaagaaaaaacgtggctggagggagcttgtctgctgcttcccccatgtgaggatgcaggaagagggcactgtctatgaaccaggaagtggccctcaccagacacggcatctgccagcaccgtcctgtgaaatgaatagtggtttataagccacttggactgtggtggtttgccattgcagtgtgaaccaactgaggcagggagtaacgctccccacgtgatgtgaaggcataaagaatggagccaggttagagggagaatgcggagaactgccctggggaccggttaggtgccccatgctgcaagcgccccaggaagcttggaaacatttaggactgactgacaagctcaaagagtcaagcaagggcggccaaggggcaccagtgccctcagagcacccacactgggcacccagcaccagcttcctgtgcccagggtcctctgtactcctcattcagccctgcaaggcaggaccctcactcgcaccgcgccaaagaggacgctggaaacgtgcagtgatctccgctctggctgtaaacagggagaggctgtgggcttgcccctagacctgactccagcacacagcagcagagcggggcccaggctgggggtgtggggcaggaacattccttcatgggggccccagagagctggaaagtaatgtaggtgttgcactgaaatgagagaattgctttaatctgaactgaacgtgctcgtaacacttagaccaggaaggatttccttttctcagggcctgagaaaaatgacctgaccagcagggttagagttttgaaggacacgcctaggcacctgcaaacttcccctcctggaggctttcttcattcatggtgtcttttgtttttgggtttgttttgttttgttttgttttgttttgtttttgagacacagtcttgctctgtcccccaggctggagtgcagcggcgccatctcgactcagtgcaacctctgcctcccaggttcaagcgattctcctgcctcagcctcccgattagctgggattacaggtgcatgccaccatgcccggctaattttttgtatttttagtagagatggggtttcaccatgttggccaggatggcctcgatctcctgacctcgtgatctgcccacctcaacctcccaaagtgctgggattataggcatgagccaccacacctggcctgttttttgggggttttttttgagactgagtctcgctgtgtcgcccaggctgtagtgcaatggcacgatcttgatgtaccgcaatctctacctcccgggttcaagcaattctcctgcctcagcctcccaagtagctaggattacaggcacctgccactgcgcccagctaatttttgtatttttagtagagtcagggttccatcatgttggccaggctcgtcttgaattcctgacctcaaatgatccatctgccttggcctcccaaagtgctgggattacaggcgtgagccaccgtgccaagccccatcgtgttctcatctgtggtgctttgacatcttggggtctcgtggacctagagagggactcccctcccagggttagctaattcctagagacagctgaccacttgcctctgagtatgccttatttactttattttttctttttttcttttttttttgaggcagggtctcactctgtcacccaggctggagtgcagtggtatgatcatagctcactgtcgtctcaaactgctgggctcaagagatcctttggccccagcctcccaaagtactgagatcccaggcttgagccaccgtgcaggctgagcatacctttgatatgcagagcaaccatcatgagtcccacctgcctcctttcatcaggctcctgcattcctgaacactagccccctgccctaaatcaccccaaggccaggtaccagctagctagataccacccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtctctgtgtctgtcatcttatcacatttgatcaaaataactcctgggtactcaatagccctgtccccccatgcagcagtcagcaggggaaatgagaaagcaagcttctatggccttctcaccttctcacctgctgcctggccttgggcaagtgcttcaatctctctaggtttctacttcctcatctgcataacagggataagaatagcccaccctagcactgcggagtatgatggaggacatgtgtctggtagacagactgctcagaaggcaagtccctgttcctgtctgttctccgcaactcgagtgagacttggtgaggctccagtccaccttccaccacagaagtcaagggccaggccaggacagtggctcacgcctgtcatcccagcactttgggaggcagaggtgggaggatagcttgagcccaggagttcgagaccagcctgggcaacaaagtgagatccctgtctctacaaaaaatttaaaaattagctgtgcgtggtggtgcgtgcctctagttcagctacttgggaggctgaggcaggagaatcgcttgaacccaggtgactgaggctgcagtgagttatgatcacaccacagcactccagcctggaccatagagtgagactctgtcccccccaaaaaaacaattaggccgggcacagtggctcacacctgttatcccagcactttgggaggctgaggtgagaggattgattgagcccaggtgtttgagaccagcctgggaaatatggcaaaacagcatctctaacaaaaatacaaaaattagccaggtgtggtggtacatgcctgtggtcccagctactcgggaggctgaagagggaggattgcctgagcccaggagacagaagttgcagtgagctgagatggcaccattgtactccagcctgggcacgacagaggcagattctgtctttttttttttttttttttgagatggagtcttgctctgtcgtccgggctggagtgcagtggtgcaatcttggctcactgcaacctccgcctcctgggttcaagtgattctcctgcctcagccttctgagtagctgggattacaggtatgagccactgtgcccagctaagttttgcagttttagtagagacagggtttcaccatgttggccaggctggtctggaactcctgacttcatgatccgcctgcctcagccccccaaagtgctgggattacaggcatgagccactgtgcccagccatgactttgtctctaaataaataaataattttttaaaacccttagggacccagcacagtggttcacacttgtaatcccagcactttgagaggctgaggcaggaggatggtttgagtccaggagatctggcctacagtgagccatgatggcaccactgcactccagcctggttgacagagcaagaccctgtcaagaaaacaaaagaaaaaaaaagaaaaagacaaacaaaacctaacaaaaccagaaatccatcctgcacgaagagcactgaggttgagtgttggttgacacgtgttgcggtaattgctgttctgatgtctgtgaatgtccttggctgatttctgtattagggcctgggtgttttcctttcttttctaatatttaagttatgtcctggcttattgtgatgatattctattgtgggaaagaaagaagtgttaaaatttatgcatcaaggtccctcttaatcttggggctcaggataaccacagtcaagaggggagagttttattcctgaatccaggtcatgctgtgttcaactttacaccctgatttgtcacacaatcacatatctgagaatttccccatgttgctaaaactgaggcagcgttccgttttgctggttattccacatcccatggggtggatgtgccagggcaagttttgtcatttcccctggactggacattcctttctgtaggtgttgctgtttgaaatatctcacacacctggacctgtgtccctgttgacatttccagtgtcacctgcaggatgccatgggatacccatgagcccaggcaaatctcccaagacgctgccaagccactctgcagagctgctctgggtcctgccccaggtgctgtgtgagggagctgcgctgcctgcgcccaacccaggaggggagcagcgtgcaggacaccgaggatgtcatcacgaccttaggtctgtattaggtctagattagcctgcattaaggagaaggtggtgatgtgtgtcttttttttttttttttttttttttttttagacggagtctcactctcttgcccaggcaggagtgcagtggcacaatctcggctcactgcaagctccgcctcctggattcaagcaattctcctgtctcagcctcccgactagctgggactacaggcgcccgccaccacacccgactaatttttgtatttttagtagagacggggtttcagtgtattggtcaggctagttttgaactcctgacctggagatccacccgcctcggcctcccaaagtgctgggattacaggtatgagccaccgcacccagccatgtgcatctttttataatttacaattcgtgatagtagtgacaactgtctcacttattcttttgtgaatcttttgtagcttctctaaccattttccactgggaattttttagtggtcttatggacttgtatgatttcctttgatattaagaatgttaccctagtgagccaggcacagtggctcacgcctgtaatcccagcactttgggaggtcgaggcgggcggatcatgaggtcaggagatcaagaccatcctggctaacacggtgaaaccccgtctctaataaaaatacaaaaaattagccaggcgtggtggcaggcgcctgtagtcccccctactcaggaggctgaggcaggagaatggcatgaacccgggaggcagagcttgcagtgagctgagatggcaccactgcactccagcctgggcgacagacagagcgagactctgtctcaaaaaaaaaaaaaaaaaaaaaagaatgttaccctagtgaaacattcagtattcttacaaagatcatcctcaatagtttgttgcgttgggtgagggttccctttgcacgtttggttttttcaggacggggcgcagccccagccagatggcgcccggctctccagccagcggcagctcaccctgctgtggtttgattttccctacacaattaatacatgttcatcatggagaaaataggagataaagataagcaaaaaggagaaaccaaatcaatggaatccccatcacacagagatactttcttaacactttggattaatttgtatcctatcaatatttttctatacctgaaaataggtgttttatatgtataatcactaacatgtaaatacatactgcacatggacatgcattttcacatacatttttgttttcttgagacagagtttcactcttgtcacccaggctggagtgcagtggcacaatcttggctcaatggaacctctgcctgctgggttcaagcgattctcctgcctcagcctcccgagtagctgggattacaggcgcgcaccatcatgccccactaattttttgtatttttagtagagatggggtttcactatgttggccaggatggtcacaaactcctgacctcaggtgatccacccacttcggcctcccaaagtgctaagattacaggcatgagccactgtgcccggcctttttatttttattttttgagatggagcctggctctgtcccccagactggagtgcagtggtgtgatcctggttcactgcaacctccacctcctgggttcaagtgattctcccacctcagcttcccaagtcactgggatcacagatgcgcaccaccatgcccaggtacgtttttgtatttttgttagagatgggactttgccatattgcccaagctggtcttgaactcctgaggtcacgggatctgtgcgctttggcctcccaaagtgctgggattacaggtgtgagcccctgcgactggcctgtttttagctacttttaactcactatttctgccagctgtagaatattctatcaggttctatcatggctcacctaaccctgttctactctacaaccccggggttgattccaggcctcactctcagcagttgagctgctctaagggtgaccgtgggaactgtccacaggtgcggctgcgggtgcagcgatctcagcggtcttagagctcttggccatcccccacatggcttcccagaaaatgcctccaggaggagggccctgctgtaccttttttgtgaccattcctcctcagcctcagtcatggccatgtgctccaaccatgggagtggatgcggcagggcctgtctaggggttcggcagttctgtccctctgccatagcatgggctgggcagggacctggccacgtggggctgcttcctcagcccagctcctggcaggagaaggagtaggggcgctgtgggctggagccgccaactgaccagtgctggccctggaggaggcccctcccccactccccgacttcagcagggcctgctgtgtgtctgtgtcatcttagcccaggctgaggagatgaatgcgtttccaagcagcccatggtcctggcgcccgactggaaaagcctgagccttcaccctaggtggagggacctagcgaagccaggcggacagaggaaaggcctcggcccatcctgtcccatgactgggggttggggcttcgtctttttaataccaatggaatcctagccaagcattcagaaccttgaagctttaacttcttaaataataataactcccacaacctccggggaccccgggcagcacgtggtaggaccagctttcaggttgtcctcctgagaccccagggctctgaaggatcctcttcttggacctcctccccaaccgtgcccagccaccccagtcatccgagaggtttgtctcaaaccaagttcctgctttaaagaaaacgctaccagagaaagcacctgtgctccaaacacgggggtgagggctcacaccatgccagggtcatagcatggggagggatgcctcccagccttcaggggatctcctcctgtgacccacagccctcaagagaaggaccagcacagcatcattttccgacagaggagggcagtgcaaataacaagttctggctaaaaagttactctgatcacccaagggacatctgtgcacttggaaaatacagaagaccacagtcccatcaccaccatcccaccttaaaaacaaacataaacgtggtcgcaggcgtgacacatggtgtgtttcgtgtccctgctttcctgcctggcagaagcattgatgtagacccaccatacgggttcttcgggccactctggtacagactgtgtgggtcatatcccgacccctggcagctgcataacctcacaggccgccatctcctcttttgtcacttgggatgggacagaactgtcacgtcccttaagggctcacaacggtgcctggcacagaggaggggcaccgctcaatggtggcagctggtgccaagccctgctgtgcacggcttagtcaccccgcatctcctcacttgacccccagttgtagtccctgcctgggttagacgctggcatacacaggcaccatgtgtcaggcggcccatccgtctgactgcaactgcacgctcgccaggtccagcagcgccgtacgctcagttctggggtcaatgggtgcctgtctcctgccctcccatcacagacagcctgtcctcctggggtatggctaccccctctctggacatagtcacttctccccctaccctgtctcaaaggtatgagatccaccggccctctgcccgccgagcagctggccaaggtcagacagaccctcatggctctcagtgtaccaccttagaggagccaggggcgcgtgggaaacacagagtcccttgttctctccgaagtgggaccctgactttaagcagtcgcagctgtttgcagttctagatacaggagttacagctggaggctgagctctctcaacggaggaagcagcggcatgagggcctttgcagaaggagctgacggggcactggggtggcaagccccgtgggccaggaaagaaaccagctccaggtcaatttgctcgggctggatttgtttcagtaaaactacttgtagacaagacacagggcgaagagaaaagcaactgtaaactaactgtgaaacaaggaaacagaagagaggccagaaaaccgtttcctaaatctcggcttggcatctggtgctggaccacagccgctgccaaacagatgggggaagcaccctccctgagccccagagcctacacgtcgggccccagcggctctagccattgcctcctctttgcttgggtccccaagttcactgttaaccccagggccaggagccagccttggccccagacatttgttctccattgtcctgagcacaacgctgaaaagcggcgctgaataaggatgctgggacgcaaagagggcgcccggggtcatctggagccctggaggctaagctcggcagcctggcgccccgagtggcttcgagtccccgcgaccgccgccaggcccggccacctccttgccacctccctgcgtcccggggaacccacgcaggggggcgcgagggaggggctcggggacgggcggggcccgcacagccgggccaacccagcgggggtcggcaggagacaaggggcggcgagggcaggggggcggggagactcggggcatggcggggtggaggcgggaaagtgtcgaggccggggaatccgcgcgtggggaggtgggcatcgccagggcgacgatgagctttccttagggggcggcgcctgaagctggccgggacccggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcattt

SEQ ID NO: 1334 - DNA, 106293 bp, Homo sapiens; identical to SEQ ID NO: 1333

SEQ ID NO: 1335 - DNA, 44808 bp, Homo sapiens
gtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcaggaaggaaaggtggtatggaagcgaggcgcggcacgctcaggcctcaccagaacctcccagccccaggcacaagtgagacttctgtgaacccagtaccaggacaagggactgcaaggaacctggagccgggtcgggggaaccagaaacggtgggggcttccatctgatcctggagaaagcgtgcacccccacacacccgcctgcccagtcaggtgcccaccatatggtggatctgctgcccacacacagcacagaagagacagtggcactcatgctccatcccaagggcacttgctgagcacctatcaggcgtcaggcaggcagtcctcccgagagacagaaaactagacctggggcccccttggtgagtggtgagcctgcaggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccacgcaagaacctcgcaagcaatcagatggttaggacgccagcccactcatccacgccctgggctggaggcccctgacctctcttgcaactccatgcagaacagcaaggcctcccaccctaagaaggtgccagggctgggtacaggggcattccgacacagagcagaacccccaggacggctgggacgtgagcggtgaggcccgtgaacaaaggtgcatctgaaggcaggcagtcccagagggccgagacaacgggcaggaccgactgcagcacagccaacagcctcacaagaggcactatgagaagaccggcggcaggggtggggccagtgacatcaaaggaaaccaaaggaaagcagtaagaactacctggggaaacgcccgtgacagccaacacacaccaacgggaaaagtgaacgaggccagaaggctacaccctgtgtgactccaagcatacaccttccggaaaaggcaaaactatggagacagcattaggtcagtggccaccaagggctggggaaaggcagggtgggtgggccgagaggagggttccaggacgctgcagctctgcaccactccgcactggtgggttcacatattgcatatttgtgaaaacccatagaaggcacagccccaagagtgaacctcaatgtgaactgtggacttttcttatcaacaacttggcaagacgggctcatcaaccataacaaatggaccagctaacacaagatgttaataacatagggaaattggggattgaagggggtgtatgggaactctgtactttctacacaatttttctgtaaactaagactgctctaagaaataaactctactgggctggacgcggtgactcacgcctgtaatcccagcacttcgggaggccgaggtgggtggatcacaaggtcaggagatcgagaccatcctggctaacatggtgaaaccccgtctctactaaaaatacaaaaaaattagccgggcgtgttggcgggcacctgtagtcccagctacttgggaggctgaggcaggagaatggcgtgaacccagaaggcggagcttgcagtgagccgagatggcgccaccgcactccagcctgggcgacagagcgagactccgtctcaaaaaaaaaaaaagaaatgaactctaaggccaggcgcagtggctcacgcctgtaatcccaacactttgggaggccgaggtgggaggatcacctgaggtcaggagtttgagaccagcctggccaacatggtgaaaccccgtctctactaaaaatacaaaaattacccagggggtggtggcgggcacctgtaatcccagctacttgggaggctgaggtgggagaattgcttgaacccaggaagcagaagttgcagtaagcaaatatcgcaccactgcactccagcctgggcaacagagcgagactcagtctcaaaaaaaagaactctatttaaataagaaaaagaataaaggccaaaataaaaaaaggcaaaacaattcaacagaagcttcatgaagacaaaaaaaaatagccaacaagcacatgaaaaagaactcaactgcattaatcatcagaaatgcaaacaaaactgtgacaatgccacgagcccgcgacgtcactgaatgccggcgaggatgtggggcaagcacagctcacccatgctgctgatggaagcgtgaagtggtacaaccaccttgggaaaaggcctggaagtttcttacaaagctaaacacacacctctgacccacctattccactcctaggtatttacccaagagaaataaaaacagatgtcagccaggtgcagtggctcacacccataatcccagcactttaggaggctgaggccagcagatcaccagagcccaggagttcaagaccggcctgggcaacacagtgagaccctgtttctacaaaaaaatccaaaaattagccgggtatggtgacaaacacttattgtcccagctactcagaaggctaaggcaggaggattgcttgcacccaagaggtcgaggttgcagtgagctgtgattgcaccactgcactgagctggggccacagagtgagactctgtctctaaaaataaaaagaaatatgtccacaaaaaaacttgtagaaaaatgttcatagcagcttcattcagaacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagagctacattctgtcaccaaaaaaaaaagcatgtgaagtgacagggcacagatcatatgattccatttatagggcattctagaacaggcacaactggtctgtagtggaaggaaatggaaacagcggttgccttttgcggggctgggactgttggaaggggcatgaggtctgtccacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagacataagccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagctgcttctgaccatctgggaatcagaaaaaagtctgcagagaagaggccctgtctgcggcccccagggtgcgaaagcctggattctgccagctggggcctctttctgcctcccttctggcccctgccacgctgtgccgggtggtcttctgctcggtgcagctgagtgccagtcaaaggagagacgcgggagcacaatagagggcaggtgacacaatgccctcaaagggcgccagacattcctgagtgcggcagaggcccacgcgaggctcccatcagcagatgacaaggcccagaaatggtccagtcatgacggtgcagccctgcaccccactgctgtgccatcaaactgtcccggctccaggaaccaaccaggcttccccaccacagctgtggacaacacagcgaggggccactccactgtgaagaggatggggaaactgaggctgcccacaccctggctggctgcacgatgcttgcagggagaaaaactgcagatgggtcctgactcagacacactttccttacatggaaaagtttacagagatttacataaggcagaactaaaacttaaaaaaacaagaaatttctctcaacagcctcacatacaaatgctcttactggatacccaaagagagaagcgagggaaagtgctcttgtatatagagccccacagaaagggctgtgtccacaacagccagcagtgcaggggccggcagggccccaccctgagcggacaccagcattcccggccccatgggactggagagggggactgcggcgcccacacggcgtgaggaccaaggagcgaaacccacaccttctggagaatgatgcccagcactgcaccggcccacggctcactgcccctacccagtgccactccccttctgcaggccccccctgctctgagtgctcctcaccggcagccaacaccacctggcacgggaacacacggcccggccgaagctccgtgtagagcagtagtgcccagccccaacccaccaagggcaaggccctggcagcactcagcatacagcactcagcggccgaccaagcacccacacaggagcccggcaggcagactgggcatcctcaggccccgcacatgcctggacggggctatgacggatcctagcttggaatggggtcactcaccccagagctcggatgccctcagcaccccaagagcaggacccatcaagacccagggcctaggtcatgagcagccctgccctcccgaacttcccagagaccaccctgctcctccgcctggaggtgtggcacagagcaggtgctctgggagtccctgaatgactgatgcggggtaggagacctgctggctgccctttgtccagatacctctgacctccagggaagagccagtgggtcattgctgggccttgcccatcccctgcacagtgactaaatccctgagccactgctggctgccacaccccacggtgggctcctgtgtgcagtacaccctgaataatctagcacctcaccgctgtcatcatgcatggcctctgtgaagttcaagggtacccaggtgccttctcaaagatccctgctctgaagactgagcctcccacagagctgggagcctggctctgtcccagccacactgaggtggtctcacggataatgcagctgctatccaggcagtcacctgacgctcccagcccctggctttcaagcacacacatgcaaccaggcacatggatggccccaggaggagctgagtggcacgagtgtaaggtgcagtgtctcagctcgggcctccttccaattctcgccaattctaataagctgtcatagtctggcagtgccaggccaggattgcctgaggacaggagttcaagaccagcctggacaacatagcaagaccccatctccatttaaaaaaaaaaaaagtggctggacacggtggctcacgcctgtaatcccaacactttgggaggccgaggcgggcagatgacaacgtcaagagtccgagaccagcctggccaatatggtgaaaccctatctctactaaaaatacaagttagccaggcatggtggtgggcacctataatcccagctactcgggaggctgaggcaggagaatcgcttgaacccgggaggcagaggttgcagtgagccgagatggcaccactgcactccagcctgggcaacagagtaagactccatcaaaaaaaaaaaaaaaaaaaaagtaggagcctagtgctcacagtctcgcttggcaagggaagatagagtttacagttcagtggcttccgagccagccagacacgaggggccaagctgccaagagaagaggaagcaacttcaacaagcgagcagggcacagtgcacttagtccctttacggcagctgccgcccctggagccacaggcaccaggctgaggcccgccaagcccagaagtcagctctgaaaggcaaaagagccgagcaggaagttctgcagtcccgaggtgccaggaagggacacctgggtcctgccacgatccttcagccgggaaccaagacggaccagcagcaactggatcagagtgagctacctgcgtgctctctgcttgctcaagaaaagttaaattcccggccgggcgcgatggctcacgcctgtaatcccaacactttggaagggtgagatgggcggaccacgaggtcaggagatcgagaccatcctggctaacacggcgaaaccctgtctctactaaaaatacaaaaaatcagccggatgtggtggcgggcacctatagtcccagctacttgggagactgaggcaggagaatggcatgaacctgggaggcggagcttgcagtgagcagagatggtgccactgcattccagcctgggcaacagagtgagactctgtctcaaaaaaaaaaaaaaagaaaagttaaattccctctggatggaaaagtatccatcatctctgtaatattttagacctaatattccagcgattcaatgaaaaattaccaagcatgacaaaagacaagaccaaaggaacaaaaacaaaaagaaaatcaagataataaaaacagaaccacaaatgattcaactatttggcttatcaatgactttcacctaactatgaagaaatgaagaatcttaccaaagaactggactctaataaaaggagtcttagtgatggctcacatctataatcctagcacgttgggaggccaaggcaggagaatagcttctgcccaggagttcaagaccaggctgggcaacatagcaagacaccattctctacaaaaaataaagagcccaggagttcaagaccagcctgggcaacacagtgagacctcatctctataaaaaattgatggccaggcgcgattgctcacacctataatcccagcactttgggaggccgaggtgggcggatcacgaggtcaggatatcgggaccatcctggctaacacagtgaaacaccgtctctactaaaaatacaaaaaaaaattagccgggcatggtggcgggtgcctgtagtcccagctactcgggaagctgaggcaggagaatggcatgaacccgggaggcagagcatgcagtgagccgagattgtgccactgaactccagcctgggtgacagaatgagactccatctcaaaaaaaaaaaaaaaaaaaaaaaaattgagtgggtgtggtggcgcatacctgtagtcccaactactatggaggctgaggtgagaggattgctcgagcctgggaggtcaaggctgcagtgagctgtgactgcaccactgcactccagcctgggcaacacagcgatattccatctcttaaaaaaaaaattaagaagttagtagatgggttcaacacctgattagacacagcaaaagaaaggatgagcaaaagagagaaaggctaatatatggagtcccagaacaggaagagagagtggagcagaaactttatttgaaaagatactacccaagatgtctccaacgtagacaaaagacatcaagtcataagttctacttatccttttttttgttttttttttgtttgtttgtttttttagagacagggtctcactctgtcgcccaggctggaatgcactgatgcactgatgtcatcacagctcactgcagccttgacccctgggcttaagtgatcctcctgcctcagcctcctgagtagctgggactacaggtgtgcaccaccacacctggctaatttcttttattagcctaggctggtcctaaactcctggcctcaagtgatccacccacctcagcctcccaaagcgctgggattacacccataaactaccacacccagccaagtcacaaatccttgaacttctacaaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaatttatagcctcgagtgcttatgttagaaaaaacaggccagatacaatagctcacacctgtaatcccaacactttgggagtccaagatgagaagataactggaacccaggagtttgaggccagcctgggcaatacagtgagaccccatctctagtgcacctatggtcccggctactcgggatgctgaggcgagagagtcgcctgagccagggagttggaggttgcaacgagctagggtggtgccacagtggtacagcctgggagaacagagcaagaccctgtttctaaaaaattttaaaaaattaatcagtgttatttacgttaggtaacagattaaggggaaaatgtacatgaaaaaatcataccaataaatacattggtgtttgataaaattcagtatttttcatgacaaaaactcttggaaaattagaaagcaaggtaacatcctcaagctgataaagagtcctatacacaaaagtctaccgcagatacatagagcgaagggcagaaaacacccctcccaggacaggagagagccaggcacatctccctccccaggaccatgctgagtcctcggcatacaaaaggcaggacaaacagatgagaggtgtgtgggttagaaaggaagaaccaaggctgggcggggggttcacacctagaatcccagcactttgggagactgagggaggcagatcacttgagctcagaagtttgagaccagcttggacaatacagcaaaaccccgtcgccacaaaaagtacaaaaattagccaggggtggtggtgtatgcctgtagtccagctacacgggaggctgaggtgggaggatcgcttgagcctgggaggcagaagctgcagtgagccaagactgcgccactgcactccagcctgggtgatcaagtgagatcctgtctcatgaaaaaaatgaaaagaaagaagcagaactggcattatgagcagcagacacagttgtgtgcattaaaggagagactccaaaactcaaacagtaagatcgacaattgaatttggtaggaatgatgtattaataatgtcaacatacaaaactcagctaaacctctgctacgccagcaacaagacaccaccgacaaggggcccacatgggcccacgctgggtgtgccggtgtttccaggtcagcctttcggaagtctgaaatggcaacttttttttttttttgagacggggctcactctattgcctaggctggagtgtagtggtgcgatcatggctcactgcagcctcgacctcctgggttcaagcgatcctcccacctcagcctccccagtaggtgagaccacaggtacacaccaccagctggatttttttttttgttttctttttcttttgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggcagaggccttgctcccacgcgtggccaggcacgccatggaggctgaggctggcaggccatggaagctgggcatgctctttgcagacctacgtggggacaggtgatggcaccatccacagtgctggccccagggctctgacgccctctagggctcaccagcctgtcaccatcccaagatgccctctcacatgcaggcctagggcagcctggctggacaggaacaaatgtcaaagacccacaaaccagctgtgggcaaaagctgcaataacaagtcgagacacacagccaggaaaagcacactggccacaaactacctgctcgacaatggcagaggtgctcattccagctgagtctctgcccggcatgtccaggtcccgtgtctcagccctgctgcccacgcagcctccctgggctgggagccaggagcagactcaggcctagggtcagccgggccttgccagactcagtgggactcagcagcaccccgttcctcctccaggaatccgggactggctgtgtcagccaccaggctacggggccaagagaggaggtgtgtgtgcacagcccccggcactttcggggtgatagtggacacacctgaggatcgggcaacaatgaagggtgggcagaaggaggaataagcttggatgttcttaaatcaagcccttgttccttctgagagaggatttcttgtatccagccctgggctcagggcactggtcccacccatgggctggacgatacgataggaggatcctggggggcctctcctggggtgggggccatgcaccccacaacgtaagctcactgcacaggaccctccacgtcctgctgacggcagggtggaggtggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcggtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtccttagcagctttataaggtacaagtttgtgccacaaacctgcctgttcacagtgcaccgggcagtgggttttcgtaaatccccagagctgagcaaccaccaccaggatctaattttagaatgcgtgggggacacggggtggcttcctggatgctgccactgtgagcactgtgcgtgagcctcggtggggacacaggtactcttttcccttgggcacacacttagtaggaggatcgctggagcgtgtgggaactttgtggctaaaggtggtcctgccagactcagaggcagccccggcagtgccacaggactgctctccgtcctgcctgtcatcaccccatgaaggcccatgtcccagggcatctgtcccccccacaggaggcccagtgaggcagcagcatggacgtggttccaccccaccttgctgacgctggggtcccagtgccggcctgcaccctaggccctgctccacagcagtccccacacagctcctacaaacacaagggaggcagggccatgggctgaccctgggctctgctcagcttctcgctcaggaccttggtctgcttctaagagagcaggatcggagcaggcctctcagtgggaccccagggtggagccggggcaagcagacagcaggcggggcgggcagggacgcgggcgtgggctctgtctctcgccctgcagtgggctgcctgggcactctgcatcatccctgtccctaaaggcacacgtgtgctttaaacacttttacgcagaaatgacaaatttcaaaatgttgaaaggactttttttttttttttttgagacggagtctcactctgtagcccaggctggagtgcagtggcgcgatctcggctcactgcaagctccgcctcccgggttcccgccattctcctgcctcagcctcccgagtagctgggactacaggagcctgccaccacgcccggctaattttttttgtatttttagtacagacggggtttcatggtgttagacaggatggtctcgatctcctgacctcgtgatccgcccacctaggcctcccaaagtgctgggattacaggcgtgagccaccatgcccagcccaaatttcaaaatgttaaaaggacattttcagggttggatgcagtggctcatgcctataatcccagcactttgggaggccagggcgggtggatcacttgaggccaggagtttgagaccagcctggccaacatggggaaaccccatctctactaaaaatacaaaaaaattagccaggtatggtggtgcacacctgtaatcccagctactcgagaggctaaggcacaagaattgcttgaacctgggaggcagaggttgcagtaagctgagatactaccactgcactccagcctgggtgacagagcaagaccctgtctggaaaaaaaaaaaaaaagtaacattttaatgaaagatcctgatactgagggttgcctggccagaggcaccgtcagcaggctaccagctcgtcatctccaggagccctccctgcaccccactcaaaagagaagcaggccaccaggatcacctggcacccaggacacccctcgagggggaccaaccagaaaaacagaccaagacagaaaagagctcaaggtgagaagatgccacactcaggaagacgggagattataaaaaagattcggaaaagacccagagctcttagagatgaaaaacatgaaagaaatgaaacagcctgctggaagctaaagttcaggtgctgtcccaaagcaaaaagatagccacgtgcaaaaaaggatgagataacacatgggttcagtgtggcaggcagagtaacagagaagaagggagacacatctaacgacgaattcaacagaagctcaggacaggaagctgtcagagagcaaaggcctgatgggctcacactgccgtgagatttctgaacgtggagattagaggcaaggagctgaagccccgcagctgcacagcaagggccaggagccagagggccacagaactgcccagtgagaatgctggaggcaaggcgacggcaggggcgcaggctgggaggcagacatgtggccgggcacgccacgcccaccagacacagggcagggagggggaccaccttcagaggggcgcagctcggaaaaggtccctctcccagggagccattgcaggaggcacctcacaagatgaggagggtgtggaccaggaagcggggagtccccagagagcagggaaaagatgcaggtgcacagcaggtgtggacagcacagcacagagcagaggaggctggaaggctctgggctccctgtcaagaggccgaaggcagctcctgacccatgtgtgtgtctgcagatggcagcagtgggcacaggaccagatgcacagagaccagtgcaagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcaggcaccgacagaaccctcgctctgcatgcccaagggctgtgcgaggaaggcaggtgcccagctccccagttcttcgatccagtaaaaggagaccccaaattcagaaagccctggatcaactgaaacagttcttccagtaaggtgtttttctattaaagacaaacaccaagttactgcaactaccaagtcccaatattcgaggggagccaactaagcatcaagatggggccctctgggaggctctcaaaccaaaggatacgcggcgtgccctccgtacggcagaccaggtagaggcaggcagcaatcacgtgggccatcttccggccgcgggtcaggtgcctgctcacggccatcttgaagaagttgaaggcggtgtccaggcagtgctggttcagctgcagctggttccccaggtggtggatgtggcgcctccctaggacacagcacgaggcagctcttagccaaatgttcccacagaacatgaaaagtatcacacggccacagcagcaactttaagaatatagatttgtgcttttccttgtaagtttctgagctcactttttatatgtgggttccaatcactttttatttaaggacactgaaatgtgaattttctgtgatctccatgtgccatgagatcctgttctacctgtttcccttctttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctgggtcagcccacccgtcccttctcagcagggcccattctgctcagccctgcgcccgccagcctctcctctaagagccagccacccggcctgagaaaaagccaggctagcgccatcccctgcacctgcccagagggagggccatggtgtagggaaaaggaagagaggtcagactgttactgtgtctatgcagaaagggaagacataagagactccattttgacctgtgccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagctgcagggacctctgccctggaaagccgggtattgtccacggtttctccccatgtgatagtctgaaatatggcctcgtgggatgagaaagacctgaccgtcccccagcccgacacccgtgaagggtctgtgctgaggtggattggtaaaagaggaaggcctcttgcagttgagatacaggaaggcctctgtctcctgcctgcccctgggaactgaatgtctcgatataaaacccgattgtacacttgttcaattctgagataggagaaaaaccgccctatggcgggagattagacacgttggtagcaatactgccttgttattctttactccgctgagatgtttgggcggagagaaacataaatctggcctatgtgcacatccaggcatagtaccttcccttgaacttaattatgacacagattatttggttcacatgttttcttgctgaccttctccccactatcaccctgctctcctgccgcattcttcttgctgagatagtgaaaataataatcaataaaaactgagggaactcagagaccggtgccggtgcaggtccttggtatgctgagtgccggtcccctggccccactgttctttctctatactttgtctctgtgtcatttcttttctcagtctctcgtcccacctgacgagatatacccacaggtgtggaggggcaggccaccccttcaccatggtaagggcatgcccagcagaccggaggccactgcgccctcctaggggctgcgaggtgctggaggtggccaggacggcaacatccgagcacacgcgcctccctggagcaagaccctcccaaagctgcgggccacatgatggcatcaggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcacggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtcaagcctcacactgccaggcccctggcagtcagcagcatcacatggagcccccagcccggctgtggccctgccaccttgagcacctaaggccacctgcctagagctcatacagctctgaggcctgcagtccagctgagctgacgtggaaggctggtcactgtccccagagctgaggcctgggccaagccaagaccccaaaagaatggacagaaagggcatcgtgccagctgccacctgcacatgtgcagcaccagccagacacaccagcacagaccgtccccgcggcccagcaaggcccagagggaaacagagtcagctgacaggggacccgctgaagctacggctccttacctaccagctctctgctgtatgtttgaaaattctgtaataaaaggtaagagagaggtactctctgaggccacacacttgaggctgggactcgatcccaagccccgaccccacaggcaccagctcgtgttcccagcatgcagggctgctatggtcagaatgtctgactcctaaaattcctatgttgaaatcctatcccctacggggatggtattaagatgcagggcctttgcgggagactaggtcaggaggcagagcactaatgatgagctcagtgcccttaaaaaccggaccccagagaactagcccagctcttctaccacgtgaggccacagtgagaaggagctgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagctgagaggcggccctcactagagagctggggaggaggccacagtgagaaggagccgagaggcggccctcactagagagctggggaggaggccacagtgagaaggagctgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttaccatcttctttctcttttttgagatggagtctcgctctgtcacccaggctagagtgcagtggtgcgatctcagctcactgcaacctctgcttcccgggttcaagtgattctcctgcctcagcctcttgagtagctgggactacaggcacatgccactgcacccagctaattttttgtatttttagtacagacagggtttcacactgttggccaggatggtctcgaactcctgaccttgtgatccacccatctccgcctcccaaagtgctgggatacaagcatgagccactgtgcctggccaaatatgttattaataaacagatattcacatagaaaccaactactaattagctagccatagcctgcgagtctccttagacttccttccaacaaatgaattctaaaagtaaactcaggctgtgtgccgtggctcatgcctgtagtaatcccagcacttcgggaggctgaagcaggtagatcacttgagcccagaagttcaagaccagcctgggcaacatagtgagatccaactgctaaaataatcagccaggtgtggtggtgcaagcctgtaggcccagccaaggtaggaggactgcttgagcttggaaggttgaggctgcagtgagccatgatcctgccactgcagtccagcctgggcagcaagagagcgagaccctgtctccaaaaaaaaaaaaaaagatttgaggcatatcaccacttacatgtaaagtataaagcaataaagcttccagaggaaaacacaagagtatcttcagaccttggagtagataagaatttcttgaacaagtcacaaacagccctaaccataaaaactgatatactgggacttcattataattaagaaatttctggcagggtgcagtggctcacacctgtcatcccagcactttgggaggctgaggtgggaggatcactggagcccaggagttgaagaccaacctggccaacatggtgagacccccatctctatttaaaaaaaaaaaagaattggccgtgcgcagtggctcatgccggtaatcccaacactttgggaggccgaggcgggcagatcacgaggtcaagagatcgagaccatcctgaccaacatggtgaaaccccgtctctactaaaaagtacaaatattagccgggcatggtggtgcacacctgtaatcccagctactcgggaggctaaggcaggagaatcgcttgcacccatgaggcagaggctgcagtgagccgagatcgcgccactgcactccagtctggcaaaagagtgagactccatgtcaaagaaaaaaattaaaaatgagtggatgtggtggcatgtacacgtgatcccaactactcgggaggctgaagtgagagggcggctttagtctgggaggttgaggctgcaaggagcatcgactgcaccactgcactccagcccggaccacagagtgagtgagacccagtctcaaaaaaaaaaattcagaagtttctgttcgtcaaaagacaacattaagagagtgagacaagctacagacgtgggaggaggattcgaaacatgtatatccaacaaaggactcgaatccagaatatataaagaactctacaaatctgtaagaaaaagacaactcagtttttaaaaagcacaaaagacgccaataggcacttcacacagaaaggacgtcccaacagccaagaagcatgagcaaaggttgtggccataattactcaccagggaaagcgaattaatgccgcagcgagtgtgctacacacctaccagaaagactacaactggaaaggctgatgatgccacatgtgaacaaggctgcggagccactgggactctcctacactgcttcctggtgggaacatgaactggtacaagcactacagaaaaccctgtggccctatctaatgatgagcacacccagacctcaggacccagacacccattcgcaggtaaactcccaagcggagggggcacctgtgtccaccgaaggaccaggtgcaagaacacgcacagcagcttcctgtgcacagccaagaatggaaacaccctagacgtccatcaacaggaaaaggagataaactgtggtctattcatcccatgaaatactacattgcaataaaagaataaactacttacacgctccaaaacagcacgttctagaacggctccagcccagacactggcaagccagatgcggacgactagagccacaggagctctccttccttgctgctgggagcacaaaatggctcaggtgctttggaaaagggtttggcagtttcttacaaaactcagcatactctcaccacaccacccagcaatcactcagaaaaacctgcacgtgacgtttacagcagcttcactcataatcgcccaagcccagattcccttcagcaagcaggtgaaaggataaatcaactgtggcgcacctaggcggtggaatattactcaccactaaagagaaagaggccacaggctgtgcagagacctggaggacagttaaatgcccatggctgagtgacaggctgcacagagaaaggatgcacagtgtgcaactccagctctacgaccacatgaccaagcgccggtgaaaagatcaatggttgctggaggctggggaaggagggatgaatgggtggagctcaggggatctttaggactctgaaagcactctgtatgaaactgtaacagtggttacccgtcactacgcattcatctaaacccatagaacacgcaccgcccagcgtgagcctgggtgtgtggtggaagctgcgtgatcctgagcccaggtgtgcagatacagcctgaatgatcctgagcccgcgtgcgcaggtggaggctgcatgatcctgagcccgcgtgtgcaggtggaggctgtgtgatcctgagcctgcgtgtgcaggtggaggctgcatgatcctgagcccggctgtgcggtgaaggctgcgtgatcctgagtccgggtgtgcggatacagcccgcgtgaccctgagcccgggtgtgcggatatagcccacgtgaccctgagcctgggtgtgcaggtggaggctgcataatcttgagcccaggtgtgcaggtggaggctgcatgaccctgagcccgggtgtgtggatacagcccacgtgaccctgagcccaggtgtgcggatacagcctgcgtgaccctgagcccaggtgtgtggacagagcctgcgtgaccctgagcccaggtgtgtggacagagcctgcgtgaccctgagcccgggtgtgtggatacagcctgcgtgaccctgagcccaggtgtgtggatacagcctgcgtgaccctgagcccaggtgtgcggatacagcctgcgtgaccctgagcccaggtgtgtggatacagcctgcgtgaccctgagcccgggtgtgtggatacaggctgcgtgatcctgagcccaggtgtgcaggtggaggccgtgtgatcctgagcccgggtgtgtggatacagcctgcgtgatcctgagcccgggtgtgtggatacagcctgcgtgaccctgagcccgggtgtgtggatacagcctgtgtgatcctgagcccgggtgtgtggatacagcctgcgtgatcctgagcccaggtgtgcggatacagcctgtgtgaccctgagcccgggtgtgtggatacaggctgcgtgatcctgagcccaggtgtgaggtggaggccgtgtgatcctgagcccgggtgtgtggatacagcctgcgtgaccctgagcccaggtgtgcggatacagcctgcgtgaccctgagcccgggtgtgtggacagagcctgcgtgatcctgagcccgggtgtgtggacagagcctgcgtgatcctgatgagtcgatgtggggcggctgactgcagctcgtgcaccacagtggaggggggcactgacggggtcaggggaagctgtgtggtgggaggtgctcagagtctacaggaactctctgccgatccattttgctgtgaacctaaaatgctctaaaaattacaagtcttttttttttttttaaattcctttctatatgattcccactgtatgaagcagaaaaccaagtgaagccagtgggcagcaggtgctttctgagctgctgcaggcctgactcatgtggatttgtcaggtggttcatggaaggtcagcacatttcatgcactttactatgcgtgctatactaggaaaaacagaccaagagaacagaaaaagaatttccctgagaaacgcgtcccaaacgaaaggctcatcaggtcaatgaagagagccccacctagcggcatttcagaaccgtcgcttcagaacatcaaagaaatcatcccaaaaggcctgagattttaaaaacagagatcaaaacacactggcattcaacgtctcttgctggtggacccggagcagatgctccccacattccatggggtgcctgtctcaaccccttggcaaccatcccagggggaaggggcaggagtttctctctcccagaccctttctctaaatacagtctcagcgtgtccccagcaaaccaaaggaggggcctgtgacctcgcagggtgcacggaggcaagcagaggagacagagtcctcgcagaacatgactgtcgctgcgggcaggaagggtggcccgtgagtttatttccatctttgcagttttctaagaaaggcaatcaagacttcaccaaaacagtaacagtcggaagctacattcacagatttccaccaaacctggcaggctgggtggcgggcgggagtggaggccgtgggccaagcttgcagcgggaccagggctgatatgaaaacttcaaccaaggcggtatggggagaacaaaggagaataaacaaaatttaaacaaacataacccatgataaatcaatcaatcaaaataaagggttttttaaaagtaagataaatacagccaggtgtagtggctcacacctctaattcaagcactttgggaggccaaggcgggtggatcacctgaggtcaggagttcgagataagcctggccaacatggcaaaaccacgtctctactaaaaatacaaaaattagccgggcgtgatggtgggcacttgtaactccagctactcgggaggctgaggcaggagagtagcttgaacccaggaggcggaggttgcagtgagcccagatcgcgccactgcactccagcctgggtgacagagcgagactccatctcaaaaaacaaacaaacaaacaaaaggtaagataaatacgaaatacaaaataagaggcaggaagagcccaaagcatcagaaatgtgccagttataatgggccaaaatcccctcttgtgtctccagaagtatttgaaaaatacgttaggatctgcctcacagacatgctcccaggacactcgacagcaaggaggtacggcgggcccagccagccaaggcagaggaggacatcactgccacagcagggggcctgactggcagcaaaagggacgactccggcgaaaagtcagcaggaaacaggacaggggctggaccaatggcctccctcagccccacaccccacccaggcaggagcggtgcctggcccggggcaggcgggtgggagagctcactgagtgggcagcagggcatggcccctgatgctgcaggtacccaggctgcagctgcagaacctcaggtgggaacccaggtacaaagatcagcatagggtcccccagaaccacccatccccagtaagactcaagaggggtgggggccccgcagcttcccccacacagtgagtggggtccacggggcctcctgggcctgcaggtcacaaccttcactgacactcacccctaattagggagcatgtatgttccaattttcatttctttcttgaaccaaaggtatttaaaaggcttttgaaaaggtaagatgagccatttctctttctctgttgttggtttccaatcctattgcaatgcacgcgtctgcaccgacactactctttgcaatttgtataggtctgaggcacgaccaactctagtaaagataccgcgagtttttgggaaaatacagactacattctctgtggagaacaaagctcttcacatggagaaaatcttgaagtcagtagaagaaaaaaaggagatagcctagtggcaccacaagcaatgggcagagctgggccccaacccaggcagcctgaggtcaggagggcccctgggcagcgcagccccagcccccacctggaggaactgtaaacgtgtgtgccaggaagccctgaaacagacaaaacaaaaaactgacaaaactgtgggtaggacaggacggatccagtcactgtgccaggtcttcatgcacactctcggtggcagacacagagaaccagccagtggagaggaagagggatgtgctgcgctgcacccgcttcctgcaggaaacgcattcaagcgcccaacacacatgcacgtccacaaaactggccttccacccggccacggctcgaagcatttccgaagactgaaatcacacagagggtgctctctactgcagaagaatcacaccggcagtcaggaagaaaggcgctgactatactcctctactagtaagtccacagcaggacaaggaaaaaagcacaagggaagcgtaaggatccatccactctgctgtgagggatcatcgcaagcccaactacccctgccagcctaggtgtgtcggtgctggccacccgtcggcagcagcagccaggagcagaggcaggtgctcaagagcccggcctcctggagatggcccaggagaaaacagccagggtgacgtgctgtccacaagagatgttctacctgtcccgaccaccttccagcatccacactaaggctgcaggacatggctgcaccgatcacaagaatccctcacgtggtcctcaggttcctgagagtgtactcaatgaaacagtgaagccaaagagatcctagcacaaagtatccctgcctggactgacccacggccaacccacactcaatggtgaagactggatgcttccccaggatcaaggacaagaggatgtctgttcacaccactgctattcaatgtggtaaacaaaaaaaacaaaaacaaaaaacaggcactagactagaaaggaaagataacacgatcttgtaccgaaaatcctaagtgatccgctaaaaaactattcagcataaaaaatgagttcagccaggctgcaagatacaagatcaatacatatcaactgagactaaattcgacaaaagaagtacaaaacttatactctgagaactaataaaattgttgaaacaaattaaagaagacccaaataaatggaaagaaatcctgtattcaggtatcagaagactttacactgtttaggcggcagtgttccccaaaatgaccaacatattaacgcaatccccgtcaaaatcccagctgacttcttggcagaaactgacaagctgatcctaaaattcatattgccactcaagggacttcaaacaggcagcataacacttttgaaagagagcagttagaggactcacagttcctgatttcaaaactgactgcgaagcttcagtgtcctgaacagcgtggaacgggcaccaggactgtcatgcagtcactaagccaaactgaggatccagaaatgagcttttaggtttacggtcaatcgattttcagcaagggcaccaagaggatgccaactggcaaaatacagtgttttcaacacatggtcctgagaaaactgggtctgcacgtgcaggagtgaaggcaggcccttaccttacatcacatgcaaacgctgactcaatatggaccaaaacctactggaaagagaggaaggcgcaaaactccaaaaaatcataagcacaaatcttcacgatttggactggattaggcaacatttgttagttatgataccaaaagcacagccatcaagagactaaataggtaaactggatactatcagaatttaaaactttcatgctccaaaggataccagcgaaaaataaaaagacaaaagaaaatgaaaagaacgcatgaaatggctgaaaatgtcctataaatcacacatccgataaaagacttgtacctaaaacacataaaatcacacatccgataaacgacttgcacctaaaatatataaaatcacacatccgataaaagacttgtacctaaaacacataaagaactttttcaactcaatcataagacaaataacccagcagacatttctccagtttgtggtgaactggcactttgacaaaacgcagtgagaatgtcactacaatatccaactgctataaatgtgttatttctgcctccatctcactgaggccatcaagcaatggctgtggatcctgtgggatccactgggttctccccaaacagccctggcagagtctgcaggacacccaggaggggactcagggcacaattcctcctggaaagcagcctgggctgggcgtgcagggtgacgaggaagtggcaggccatgaggtccatggctgagtcagtgccctccaccctagcaccaccatccccatctctgggacccgccgcacgctcagcagcatccgcggtgggaaataccattctgcagggtctgcgctctcgactccttccccagattcacgtggaagccgccacccagagtcggggttttgccagcacctggaaacacaaaaaaagacagatcagccaaaacttggagatctgcatttacaaccctttcctaacatccacagacacaaagtgagaacaaagcgggggtcagcactcatgggggaagcagcaggtcggccccccgcacctccgtcactgagccaggaaccccagtgggggaagcatctctcactctgcccagccagcagggttgagggtgggccaactgcactttccgcattttctttttttttttgagacggagtctccctctgttgcccaggctggagtgcagtggtcccatctccactcactgcaagctccgcctcctgggttcacgccattctcctgcctcagccttccaagtagctgggactataggtgcccgccaccacgcccggctgggattacaggcactttctgcattttctaaccatgtccctaacacactgcaagtccagagtggacgctgtcaaatggctgccgggcgagaacacagatgtacctccaaacctctgcaagtggtgcacacacagcatgggctggccgtcccccttgccccaggccagcccactcagatatcactcctgcatggtgaccacatgtgaacacatccacctccctgctggactgcaggggacgcaggtaccatcccatgtgccccaaggcactgcaaccagccagtctgcagaaggcccccacgcctcagtccacccacccatggggaggctgcagctgaacctgctggacactctactccgaagctctgccaactgacagcatgcctacgacgtccaccacattctgccctgcagggcttcggggttaagacctggccctggtacctctggaaacatcaggtggacatttggattgttcaccaggttcaccagcccgatcgctgcagcctgatctcccaatgagcatggtggacatgtggattgttcaccaggttcaccaacccaaacgctgcggcctgatcttccaacgagaacagtaaggtgaggccccaggcatgcccaaagatggggagagctggaaagtgccccccgccccgcagcgtcggccctcagtggttggcacaggggccagtgcatttgtgacaaagcacagacacaggactggaggctgctgcaatcgggacgcgcagacaaccttggccacttgggggaaggcaagtgtgtagggcctgtcggaggacactggaaggataggatgcagaagcagaaagccaatcgctggagcctggggccaggccctccagggaaaccatgaggcagggacctcagcgtcatccaggggcagccaccagcacagacaaggcagaacaggcacggcctctggcttcacaatgaatgtaactgaatcccaaacaaatactaacaacactctttaaagactccagtaaaatgattctaaagttcagttggaagcaaaaaggaattagagcagccaagaaaagttttgaagagagcaaggggcagctactgggcccgtccggaaactcagagctgaacagggtcaggtggcactcagcttttcctggtggcagcagaggcaaagcccgggcctccttcaggctgaggcccagagccggcctcctggtgggtaacgtggccacaggggtggccggcagcagcagcagggcaccagcactgagcacaggcctccaacaaaggtggtgccgggacgggggcagtgcctggagactacctaggttgtcacaactgggatctatgtactagttttctgtggctgccataaaaattgccacaaacctagtggctttcaagaagctgtagaaggtccgggcgcggtggctcacgcttgtaatcccggcactttgggaggccgaggtgggtggatcacgaggtcaggagatcgagaccatcttggcgaacatggtgaaactctgtctctactaaaaatacaaaattagccaggcgtggtggcgggtgcctgtgatcccagctactcaggaggctgaggcaggagaatcgcttgaacccaggaggtggaggttgcagtgagcagagatggtgccactgcactccagcctgggtgacagagcaagactccgtctcaaaaaaataaaaataaaaataaaaataaaataaagtaaaaaagaagctggagtggtggccgggcatggtggctcacacctgtggtcccaacactttgggaggccggagcaggaagatcgcccaacccaggagttcaataccagcctgggcaacacggggagacccatttctttctttctttctttcttttttttttttttgaaacagagtttcgctctgtcacccaggctggagtgcagtggcgtgatcttggctcactgcaagctctgcctcctgggttcatgccattctcctgcctcagcctcccgagtagctgggactacaggtgcctgcaaccacgcccggctaattttttgtgtttttagtagagacggggtttcactgtgttagccaggatggggggagacccatttctacaaaaaaaaactgaaaaaaattagctgggtgtggtggcacctgcttgtggtcctactactcaggaggctgaggttggaggatcactagagcccgggaggtcgaggctgcaatgagctgagatcgtgccactgcactccagcctgggtgacagagcaagaccctgtctcaaaaaaaaaaaaaaaaagaagctagaacaggccaggcatagtggctcacatctgtaatcacagcactttgagaggctgaggcaggaagactgcttgagcccaggagttcaagaccagcctggacaacatagcaagatcccatctctacaaaaaaaaaatgagcggggtatggtagggcatgcctgtggtcccagctactcaggtggctgaggcaggcagatcgtttgagtccagaaggtggaggctgcagtgagctgtgatgcacctctgcactccagcctgagcaacacggtgagaacctgtctgaacaaataataaactaaacagaagctggagcaggtcgcagtggtgtctccttgtgggggctggagaggacctggcagggccacagtgaggtgcctgctgatatgagaatccagaagagaggccagggagaaacgcaggactcaggagagacccatcctggaataagggggctttgagcagcactgatgagccaattctaaattctgcagaaatctggcccaggcctccccaggctgagctccaggtgcctgcaactccgaccctccctcagagttctttgttttgtgagcagtgtgtattctttttttttttgagacggagtctcgctctatcgcccaggctggagtgtagtggtgcgatctcggctcactgcaacctccgcctcccggattcaagcaattctcctgcttcagcctcctgagtagctggaactacaggtgcgtgccaccacgcccagctgatttttgtatttttactagagatgaggtttcaccacgttggccaggctggccttgaattcccgacctcaagtgatccacccacctcggcctcccaaagtgctgggattacaggcgtgagccaccacgccccgcctgttttttctaagcgttcgaattaagatcaccattctgtgtagcccctggcatgctggtctccagcacatgctccctcaccaactttcactttagaaaaagaaaaatctcactatattctaattagtgtatataatgcttttaataaataactcatataacactacattagaaaaaggacaatgatcaaagtataaaaagccagctgggtgcagtggctcacgcctataaccccagcactttgggaggccgatgcggttggatcacctgaggttgggagttcgagaccagcctaaccaacaaggagaaaccccgtgtctactaaaaatatgaaattacccaggcatggtggcacatgcctgtaatcccagctactcaggaggctgaagcgggagaatcacttgaacctgggaggcagaggttgtggtgagccgagatcgcgccattgcactccagcctgggcaacaagagcgaaactccatctcaaaaacaaataaataaaaagcccctgaagccccaccttccaagaacaggggacgccgtacagcctccattatagccacgtttccctgcctaggtacagtgggctgcaggcgtgcttctgacagaacagggccacagtgagatgccacgttaaattacagtgatgatttcgattctggttgtgttttacgcaatctcttcactccttgacccatacccatcagcttgcaccacagcacactgcaaagctgcatgcgtcagcagctccacgctccacctgccacctctgccctccctcctccatcactctgtcttgcaccctccagcctcccataccctcctcacaccccaggacctctgtttcctgtccctgtgttgttctccctgtcccccaacaccacagtcaccctccctggggccacgctgctgcacctgctctggaagcgcctcctggcttctgcttgcctcacaccctggtgcgtgcacacttgcaggcacacacacacaggacacatgtggacagtgtgaaacctcagaacactaacccacagggaggatgaaagaggaaagtgccacctctggctgaaactgccaggatgccctctacttctaaaaacatttggtattttccatagcgtgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccgacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaaattagccaggcatggtggtgtgctcctgtagtcccagctactcgggaggctgaggcaggagaactgcttgaacccaggagatggaggttgcagtgagccaagactctgtcaaaaaaaaatttttttttaactggagactttctgttgctgctgtgaaacttcctttttttaagagacagggtctggccgggcgtggtggctcacgcctgtaatcccagcaccttcggaggccaaggcgggtggatcacctgaggtcaggagtttgagaccagcctggccaacatggcgaaaccccgtctctactaaaaacacaaaaattagccgggcatggtggcacatgcctgtaataccagctacttgggaggctgaggcaggaaaatcgcttgaacccgggaggcggaggctgcagtgagatgagattgcgccattgcactccagcctgggcaacaagagagacactccatctcaaaaagaaaaaaaaagaagtctcactctgtcacccaggctaaagcgcaggggcaccatcacggctcactgcagcctcaacctctcggactcaaggaatcctcccacctcagcctcccaaataggcgggaccacagacatgcgccaccacgcctagctaatgttttcttattttttgttttctttgtttgtttttttgaagacaagacagagtttcgctcctgtcgcccaggctggagtgtaatggcacgatcttggctcactgcaacctccacctcccgggttcaagcgattctcatgcctcagtctcccaagtagctgggattacaggcgcccaccaccatgcccagctaatttttgtattttggggttttttcttgttttgtttttttagtttttgtagagacagtttcactatgttgcccacgctggtctcaaactcttgacctcaagtgatcctcccaccttggtttcccaaaatcctgggattacaagcatgagctaccaaacctgactggaaacttcttttaaggggagacacctgtaggaggcctggctggctgggcagtaatggatggagaggaattcaggggtcccacaggtgagtgcccaaaggaggctggaccagaccgcagtgcatccctgagagctggggacggggacccgggaacacagagcgtgtgcctactggtggggctggatgcagtagcatcagacatctgggaggagcactgacaaacagggccaagcacggcagcccacaccccttcccaggcgcagacccttcccatgcgcacaccccttcccaggcacagacccttcccaggagcaaccctttcccaggcccacaccccttccccaggcccacatcccctccccaggtccagaccccttcccaagcccaggccccttccccaggccactgcggaggagctggttttgtagtgattacaatttggttacggaaaacaggacgtgtgtcacgctgcaggctaaccagcagcttcctccctcacccagatggcaacgggacagaattcacccgtttcctaagagcaggcaccttcagccacaacttagggttctgggggtcatggagcagaggcagaagcctggagccttccaccctcaggactagagccccgccaggaggccaggcgcatgctcagaaccccaggccgcagggagaggctggccggtcacatccttctctgaggcagagggagcttcccagcaggcgagggcaactccaccacccatgtccccctccagggccagcgccaggtgacatgcagccatgtcacaaattaggtccggctgcatcgtgaccccaaacggaaaacagcagcactcacggacaccccagcttcgaagttctaactgtgaagccactgaaagttgtgattacgggaaacgctccccacccccacaagttctggtgacactgaggtgtgctgctccttgcacaggacgaggagggacccctgcaagcaggagcccaggatgtctggtgtgtgggcgccatcaccatcacctgctggcagagggaagcctcagggcacacacagtgcaggacactgatgtgggctcacagggaagccccgccttgcctcagtggagcagacggcctcctcagggcactgccaacggcccccaactccaccgtctgcctggcccctccagccacgctgagcctcagtcctcacccacccttctctctgcacagtctctgctcgggtgccccgggacgctggagcaccagtgtggtttcccccgtggggcctggcttccaaggtcaggaccctctggggactctcctgaggcctctggtcacctgccctgatgccttagttaaatattccagagtaaactgcgaagctgtatcaggcttagttctcaattaataggcaaaacacctaggaaagacagtggccttgggactagaaaacgacagctcagagagaaagctcagctttcaagatgaagctggaggaaggggcggctggggcctacttgtgtgccagggaaactgagaagccaccaaggtttccagccccctgtgatcaccactgtgacgagggaggaaggatgccaagtgggcacctagagagcctgcctgggagacagaggggctgcccagagcaacagatcccctctctcctccccactctcggcccaggcaccacctgcgccggtccccaggggctaagaacccgccgcctcgcagcacttcccccaggaccaccacagttggttgctgggcctgcgcctccctccagagagtgtgcctgggctcagaggcgtcttggggccacctgacagcgctggctctgagcttgttctgacagcacccgggtgacagacttccagctctgcactgctccacaccaccatcctcccccggcagggcacagtgagggcagtgcgctgtcaccaggcccggatgcacttaacactgtgcctgcccgggaaaccctgcgtctgctgccatgacaacttgctttcattactgttgttatcatcccaacagacatccaagtcttggcaactgtgacacagctgcaaactctgtgcccagcagtcctaggaagatacccagggagtatgagcatggaagacgatggggagggaagagcaggagagaaaactcaatgaagcccaagccagttcttagaaaagatcaaaaacacggatcaacttctagcaagagagacaaagggaaaaaaagacacaaaacaccaacatctgaaaggaaaaaggaggccactgtggaccccgcagatatcaaaaggataagggaatgcttcgaacaactctctgggcaaattcaacaactaggtcaagtggaccaattcctcaacacaagcggctaattcaccccaggtgaaacacagcatcttaaatataactagaacctcagtgatgaaagaagccgaaaccacagtgcagaatcttctgagaaagaaagctttgggaccagatggctacgctggtgaattctaccaaacatttcagaaagaaagaacaccaactctacataatgtcttccagaaaatagaagaggaaacgtttcccaacccattccataaggagcagaaccctgatacccaagacaaggacgttacaggaaaaactacaggccaatatcccacgcaagcatcagcaggaaccctcaacagaacatccggcgctgagcaaagcagctcatgccgctaatcccagcactctgggaggccaaggtgggaggatgccttgaggtcagaagttcgagaccagcctgagcagcaaagcaagaccacatctctacaaaaaaaaaaaaaaaaaaaaaaaaattggcgttggctcacacctgtcatcctagaactttgagaggccaagacgggagaattacttgagcccaggagttccagacgagcctggtcaacatggcaaaaccccatctctacaagaaaaatacaaaaattagctgggtatagtagggcgcacctgtagtaccagcaactcaggaggctgagctgggagggtcactggagcccagggggttacgactgcagtaagccatgaccactgcactccagccagggtgactgagcaagaccctagaccctgtctccccaaccaaaaaaaaatttttttaattagctgggcatggtagtgcatgcccgtagtcctagctactctggagtctcaggtggaaggatctcttgaacccagaagttccaggctgcagtgacctgtgatcacaccactgcactccagtctgggcaacagtgagactttgtcccagaaaaaaaaaaaaaagctgggtgcggtggctcacgcctgtaatcccagaactttcaggggccaaggcaggtgtatcacttgagattagaagttcaagaccagcctcaccaacatggtgaaaccccatctctactacaaatacaaaaaccagccgggtatggtagtgggctcctatgtaatcccagctactcaggaggctgaggcaggagaatcgcttgaacccaggagggggaggttgcagtgagcccagattgcgccactgcactccagcctgggcaacagagcgacactctatctcaaaaaaaaaaaaaaaaaaaaaactcaaggagtgtattaaaaactcttaggggccaggtgtggtggctcacacctgtaatcccagcactttgggaggccaaggcgggtggatcgcctggccaacatggcaaaaccccatctctactaaaaatacaaaaactgcggccgggtgcaacagctcacacctgtaatcccaggactttgggaggccgaggtgggcggatcacgaggtcaggagattgagaccatccatgtaaccccgcctctgctaaaaatacaaaaaattagccgggcgtggtgctgggcgcctgtaatcccagctacttgggaggctcaggcaggagaatggcatgaacctgggaggcagagcttacagtgagccgagattgtgccactggactccagcctgggtgacagagcaagacgccgtctcaaaaaaaaaaacaaaaaacttagctgggtgcggtggcgggtgcctgtgatcccagctacttgggaggctgaggcaggagaatctcttgaacctgggaggcggagattgcagtgagccaagatggtgccactgcactccagcctgggcaacaagagcaagacaccagctcaaaaaaaaagaaaaaaaaaaaaaaacctcttagaacaagtaagtttagcaaagccataggaaacaggacaacacacagaaatcaaccatatttatataaacaagcaatgaagagttgaaaactaaattaaaaaaattccacttataataactcctaatagagcttaggtacacatctaaaaaatgtccagagggccaggcacggcagctcatgcctataattccagcactttgagaggctgaagtggggggggatcacttgaggtcaggagttcgagaccagcctggccaacatggtgaaaccctgtctctactaaaaatacaaaaattagccaggcgtggtggtgggctcctgtaatcacagctacttgggaggctgaggcacgagaatcgcttgaacccaagaggcagaggttgcagtgagccgaggttgcaccactgcactccagcctgagtgacagagcgagactccatctcaaaaaaaaagtccagaagctgtatgctgaaaactacccaacactgacagactatatcaaagaaaatctaaatgaatgcaaacatacactgtgttccatggactacaagattcaacatagaaaaaatgtcagctgggcacagtggctcccacctgtaatcccagcactttgggaggccgaagagggcggatcacgaggtcaggagttcgagaccagcctggccaatgtggtgaaaccccgtctctactaaaaaatatacaaaaattagctgggtgtggtggcgtgtgcctgcagtcccagctactcagaaggctgaggcagcagaatcacttgaactcgggaggcggagggtgcagtgagctcagatcgcgccactgcacttcagcgtgggtgacagggtgagactctgtctcaaaaaaagagaaagaaagaaaaaatgtcagctctccctaaatatatcaagaggtttaatgcaattccaatgaaaaccccaccaggacttttgtacaggttgaacatcccaaatccaaaaatctgagattataaatgctccaaaacggcccggtgcagtggctcacgctggtaaacccagcactttgggaggctgaggcaggtggatcacgaggtcaggagatcgaaaccatcccggctaacacggtgaaaccccgtctctactaaaaatacaaaaaattagccgggcgtggtggcggtcgcctgtagtcccagctacttgggaggctgaggcaggagaatggcgtgaagccaggaggcggagcttgcagtgagccgagatagtgccactgcactccagcatgggcagcaaagcgagactccgtctcaagaaaaaaataaaataaaaaataaatgctccaaaacatgaaactttttgagtatcaacacgatgctcaaaggaaatgctcactggagcatctcagatttcagatttttcgattagggatgcttaaccagtaattataatgcagatattccaaaatcagaaaactctggtatccaaaacacttctggtcccaagcatttcaggtaagaatatgtgacctgcagagatgcacaaacttactctaaaattaaaaagagaaagggaaattaatagccacaacaactttgaaaaggaagaacaaaggttgagggactcacaatatctgatttcaggacaatataacaggtatagtaaaaaagcgtgtgatgctgacaaaggaaaacggcacctgatcaacagggcaggacacaaggcccagagacagacctgcacggacggggcccagtgagcacagccgagggagcaaaggccttcagtctttcaacaaacggtgttgaaacaaggggacctccagataaacaatgagcctcagcctacaaagcacaccttatacaaaacatagatggaccacagatttaggccaggtgcggtggctcgcgcctgtaatcccagcactttgggaggctgaggcaggcggatcacttgaggtcaggtgttcaagaccagcctgacgaacagggtgaaaccctgtctctactaaaaatacaaaaattagccaagtgaggtggcgcacgcctgtaatcccaggtacttgggaggctgaggcacgagaatcacttgaacctgggaggcagaggttgcagtgaaacgagattgtgccactgcactccagcctgggccacagagcaagattctgtctcaaaaaaaaaaaaaaagttaaaacttctgctttgaggccgtgcgcagtggctcacgcctgtaatcccagcactttgggaggccgaggtaggcggatcacgaggtcaggagatcgagaccatcctggctatcacagtgaaaccccgtctccactaaaaaatacaaaaaaaattagccgggcatggtagtgggctcctgtagtcccagctactcgggaggctgaggcaggagaatggcgtgagcctgggaggcagagcttgcagtgagccgagatcgagccactgcactccagcctgggcaacagagcaagactccatctcaaaagaaaaaaaacttctgctttgaaaatcacatatacaacaaagggcttgtaactacaatccacaaagaactcccaaaactcaacaataagaaaacaacccaaataaaaaatgagagtcagggtgtggtggctcacgctgtaatcccagcaattcgggaggccaaggctggagtatcacttgagcccaggagtttgagaccagcctgggcaacatagagaccttgtctctactaaaaataaaataaaataaatgatcacagcatggtggcatgcacctgtagtctcagctactcaggaggttgaggcaggagaattgcctgagcctaggagttcaaggctgcagagagccatgactgggccattgcacaccagcctgggccacagagtgagatcctgtctcgagataaataaaaaaataagacttgagcacacatttcaacaaagaggattcgggcatggcaaataagcaccctaataaggttgaacatcactagccagtagagaaatacagaataccactatgatgagatgccacacacctgttagaacaaccgaaataaaaacatcgacaacaccaagtgctggtgaagatgtggggcaactggtgagaatgcataatggcacagccacatcacaaaacagttcatgacagtttcccatagagttacacatacagctaagttccccagagaaatgaaaacgtatgttcacacagagagctgcaaatgaatccttttagcagctctattcacaaccacctgaaactggccacagtccagctccttccacaggctggggtccatccccagcccgcaatactgcccatcactgaaacgtcccctccgaggcctgcagcagcctgagtggccctagggcatccgcccggtaaccaccaaggccaagggcagcagcaatcggattctaagtaccagacattgctgaaaacaaaactgcaggcacagagagtgacagtgaggggcagcttgaggggccttctgggctccccaggctctcttcaaccctccctgtgctggctgccctggcccacgcgtgtgtcgaggaagtccacgcacgccacgggggtccacaggcgcgcgaagaaggtctacattctcgccaaggggatccacactcgcgcccagacggcgcagaaccgcgcgccccgacagagcgtgcggtaccgaggcgctggtcccggccgcgccgtcaccgcctccagcccgcctaagccgcaccgagaaatccgcgcagcgccagcccgcgggactcaccgtccagggacacgaactggcccacggccgaggagccgccgccgctgctctccacgaactgcacctcggacacgatgatgttgtcctccagcactgagccgcaggcggtgcacaccgcgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccg

SEQ ID NO: 1336 - DNA, 40120 bp, Homo sapiens
atttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccacgcacctcccaggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctgtgcctatttcctcgaggaaaatgccgggaaatagcagcgcctgcccctgtaaagccctcagagcagagtggaccgcgctctctgcaagcgctggctgctggcgtccgtagcaagctaaatcgcgaagcatctgaacgaacgaggaagcccaacgaccatcccacaggccgcggccagaggcagactccggaatgcaaatggccaaacaagcaggtccacctgcgttcctaaccaaaagatcgctaactgaagaacgggcgcaagcacctgcgcatggcactgcgggtctgggggcggccgcctgccagcgccgggagccgccttccacggctacctctgcacagcgcgcggctcgcgccggttgctgggcagaagctcgagcagcttcgaggatgtcgggcctgggggcggggccgcgaggcagcgacgtcgcgcggggcgcggccctgacgcagcgtgacgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctac

SEQ ID NO: 1337 - DNA, 91708 bp, Homo sapiens
atttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccacgcacctcccaggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctgtgcctatttcctcgaggaaaatgccgggaaatagcagcgcctgcccctgtaaagccctcagagcagagtggaccgcgctctctgcaagcgctggctgctggcgtccgtagcaagctaaatcgcgaagcatctgaacgaacgaggaagcccaacgaccatcccacaggccgcggccagaggcagactccggaatgcaaatggccaaacaagcaggtccacctgcgttcctaaccaaaagatcgctaactgaagaacgggcgcaagcacctgcgcatggcactgcgggtctgggggcggccgcctgccagcgccgggagccgccttccacggctacctctgcacagcgcgcggctcgcgccggttgctgggcagaagctcgagcagcttcgaggatgtcgggcctgggggcggggccgcgaggcagcgacgtcgcgcggggcgcggccctgacgcagcgtgacgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatagggtgaaacaggctctcccaccccttgtctctctcctcccactctgcataccctgtaggcagttgttttctggaaaacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccagtcatctgcttggtaaagaaagggtaggtcagaaccatcgggcagtgagtgctgttttgatcctttccttctagacttttccgctaggttagattctgcatgcatgaacactgctgctgcctcgagggagagacaggacttaccctacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtcccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgcagtgagctacgattgtgccactgcactccagcctggacaacagcgagactgtgtcttagaaaataaggccccacattactgagctcctagcagctttaagaaacatttcttaccttgaggggtcccatgcttggacaggatttccctccactgttcaaaggacatttggcacgctggtccctacagcagcctgccggacaccccagcatctcacccagatgcctacctatggccggcgcattgatgcagagctctcttgccaagagaagaaacgtctttccaagcacgtacacattcacctgagatggagagatcacaaccagaaacagcattggtatttaaggaaatgtttgctttttttctcttaaaatgcatctcttgtgcagtctttaaagactccgatggcccgtggagcagccaccccacacccgcaagcctggctggcctcccttggctgctggggctcccagggccctgccttcttcctctaagccgctgctttaggccgtgctgccgtctcgccaatgatggcatctgcttagaagaaaacctgactgcaaggttcctcccagggcgtcatcacacggtgcacgcagcatttcattcacaactgcacacccatgaacacaaaaccagttctgtccacatgtgctcccaccagccacacctccagcccagattccgatgggcccaggggtcttggcctcagcccccttgctgggactgagatctgtgttcctcagtgactcccctgccccccacactgttcctaccttaggtccaaatccacacagatcctgtcacccctgcctcggctatctgccatagggcagtggaggtgaggcccagaccgagaagggcaacgccgagggctggcagtgatgggagcaccgctgcttgtcctcagcaaaacaaggactctagcctgtgtgcagaccctgtgcacagccctgccgtgggccgagtacccctaaggagccctgctggctgggggaggacacttcagagcaatgtctgctggcaggtgtggatgaggtgcacagcgggaatagcctggtccctactggagcctgcaagagccctgcccacacttggctgtcttcatcccaggcttgcccctggggcccccgggcctcacaggcttggccagtctgaccctctgccactagcctcccccaaagaattccctcgcctgaccaagcccggctcgtgggcccttagacaagtccccttgtcctggcccgccagtggcacttccaggtgcttgctgactccagggtactgggagacctaagggaccgcacacaaagggtcctgtctgcgctagaggcaagagacagaggcaagagccagaggcagcgcttgtgggggatgcctctgatcagggaccctgcccgctgggagggctgggcccccacagcagctcctcctggtcaccatccaccccagtggggcgcagcttccatcttctccattatatccgagggctccatcacaagggctggtggctcacagagtgtgccttctgaaggaatttcccctcctcacagtttctgggggttccagggatccctggggtctgctcaccaaactggggggcgtgtcagcacatgtagtgtgtgtgtgcatccgcatgcagtgtgcagacatgcatgtgtgtacacacgcatacagtgtgtctaggtgtgactcacgcatgtcatgtatgagtgccccagcccctgtgctgggttcctgccaggcccctgcatcttgatcgtcctgatcccaccatctctctttaagccacagcagaaccatgatctgctgctggcctctgcctgcccacctcaaactccacaccccccaaccttgtgtcccagagacacagggatcaatgagacctgaacactgcaagtgaggaatctccaaagggcctttacatggaaactcacgtttaaaaagccatgtgtgcaaaacgcgtgcagtttttttgttttagtttgtttgtttttgagacggagtcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagacaggatggtctcgatctccagacctcctgatctgcccgcctcggcctcccaaagtgctgggattacaggagtgagccaccgcacctggccgcagttttttgtttgttttcttgagacagagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgttggccaggctggtcttgaactcctgacctcaggtgatctgcctgcctcagcctcccaaagtgcggggattacaggtgtgagccaccgcgcccggcctaaatacatgcagttctttacagagttgctaccatgtatgaggaccatttattggaaattctcttgctaacagtctaactgtggctgctccttgagggcaggtcagggtggggcacagccagctgccccccccatctctcttcctgggcagcaggtggattctgcctgcagactgccctcgtgggtgtctgatgagctgtgtgcccaggccagtgaacaacctgggtctgccctaaggcagggatcaagagggagactccatgagctcgccatgggaccatctgagtccccaggagcctgaccacttccggagcagctgccctggccctggccctcatactcatcttccctgggaagtcgtggggttggaaccagggtcatgtggttttgccctgcactgagcagagagcatctgaaatgtggacttgctggattatcacaattccagcagactatttttagcttgaccacaaaatgtttcagcagtagcttctgagttgccatttataaagacagctgggaggacaaggaccccagatgccacctgacacgggcagaagcctaactgtgggctgctgccaaaggcggaaagcccttgaggaccagaggtggcagcacagcctgtgggtgcccagaacccctgtgggcacctggatctggacagagctccctttgaggagtgaaatctacatgaattctgcactgtggtcacaactgttttcaatatttctgagtcctcagcagcatggtcaccaaggacctgtggtgcagcccccagcaccgtccctgcagagcctcggtgcccccaccctgtatcctgtctgcacaggggtccctggggttggtctttccactctgtcactttgttcagtcatgtggaaagagagatgtaactgaaagtgctttctgtggtacccagaaagtgagtgtctccaaacagactgtaatataagatttttctacaatttaaaatgcatgcaagaggccaggtatggttgttcatgcctgtgaccccagtacttagggaggccttggtgggagggttgcttgagctcaggagttcaagagcagcctgggcaacatagcaagaccccgtctctactaaaaatacaaaatagccgagcatggtggtgggcacctgtggtcccagctacttgggaggctgaggtgggaggattgcttgagcccaggaggcagaggttgcagtaagctgagatcacgccactgcactccagcctgggtgacagagcgagactccatctcataaataaataaataaataaaatgcaaggtcaaaagaaataatctcctataccaaactaggtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcaggaaggaaaggtggtatggaagcgaggcgcggcacgctcaggcctcaccagaacctcccagccccaggcacaagtgagacttctgtgaacccagtaccaggacaagggactgcaaggaacctggagccgggtcgggggaaccagaaacggtgggggcttccatctgatcctggagaaagcgtgcacccccacacacccgcctgcccagtcaggtgcccaccatatggtggatctgctgcccacacacagcacagaagagacagtggcactcatgctccatcccaagggcacttgctgagcacctatcaggcgtcaggcaggcagtcctcccgagagacagaaaactagacctggggcccccttggtgagtggtgagcctgcaggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccacgcaagaacctcgcaagcaatcagatggttaggacgccagcccactcatccacgccctgggctggaggcccctgacctctcttgcaactccatgcagaacagcaaggcctcccaccctaagaaggtgccagggctgggtacaggggcattccgacacagagcagaacccccaggacggctgggacgtgagcggtgaggcccgtgaacaaaggtgcatctgaaggcaggcagtcccagagggccgagacaacgggcaggaccgactgcagcacagccaacagcctcacaagaggcactatgagaagaccggcggcaggggtggggccagtgacatcaaaggaaaccaaaggaaagcagtaagaactacctggggaaacgcccgtgacagccaacacacaccaacgggaaaagtgaacgaggccagaaggctacaccctgtgtgactccaagcatacaccttccggaaaaggcaaaactatggagacagcattaggtcagtggccaccaagggctggggaaaggcagggtgggtgggccgagaggagggttccaggacgctgcagctctgcaccactccgcactggtgggttcacatattgcatatttgtgaaaacccatagaaggcacagccccaagagtgaacctcaatgtgaactgtggacttttcttatcaacaacttggcaagacgggctcatcaaccataacaaatggaccagctaacacaagatgttaataacatagggaaattggggattgaagggggtgtatgggaactctgtactttctacacaatttttctgtaaactaagactgctctaagaaataaactctactgggctggacgcggtgactcacgcctgtaatcccagcacttcgggaggccgaggtgggtggatcacaaggtcaggagatcgagaccatcctggctaacatggtgaaaccccgtctctactaaaaatacaaaaaaattagccgggcgtgttggcgggcacctgtagtcccagctacttgggaggctgaggcaggagaatggcgtgaacccagaaggcggagcttgcagtgagccgagatggcgccaccgcactccagcctgggcgacagagcgagactccgtctcaaaaaaaaaaaaagaaatgaactctaaggccaggcgcagtggctcacgcctgtaatcccaacactttgggaggccgaggtgggaggatcacctgaggtcaggagtttgagaccagcctggccaacatggtgaaaccccgtctctactaaaaatacaaaaattacccagggggtggtggcgggcacctgtaatcccagctacttgggaggctgaggtgggagaattgcttgaacccaggaagcagaagttgcagtaagcaaatatcgcaccactgcactccagcctgggcaacagagcgagactcagtctcaaaaaaaagaactctatttaaataagaaaaagaataaaggccaaaataaaaaaaggcaaaacaattcaacagaagcttcatgaagacaaaaaaaaatagccaacaagcacatgaaaaagaactcaactgcattaatcatcagaaatgcaaacaaaactgtgacaatgccacgagcccgcgacgtcactgaatgccggcgaggatgtggggcaagcacagctcacccatgctgctgatggaagcgtgaagtggtacaaccaccttgggaaaaggcctggaagtttcttacaaagctaaacacacacctctgacccacctattccactcctaggtatttacccaagagaaataaaaacagatgtcagccaggtgcagtggctcacacccataatcccagcactttaggaggctgaggccagcagatcaccagagcccaggagttcaagaccggcctgggcaacacagtgagaccctgtttctacaaaaaaatccaaaaattagccgggtatggtgacaaacacttattgtcccagctactcagaaggctaaggcaggaggattgcttgcacccaagaggtcgaggttgcagtgagctgtgattgcaccactgcactgagctggggccacagagtgagactctgtctctaaaaataaaaagaaatatgtccacaaaaaaacttgtagaaaaatgttcatagcagcttcattcagaacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagagctacattctgtcaccaaaaaaaaaagcatgtgaagtgacagggcacagatcatatgattccatttatagggcattctagaacaggcacaactggtctgtagtggaaggaaatggaaacagcggttgccttttgcggggctgggactgttggaaggggcatgaggtctgtccacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagacataagccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagctgcttctgaccatctgggaatcagaaaaaagtctgcagagaagaggccctgtctgcggcccccagggtgcgaaagcctggattctgccagctggggcctctttctgcctcccttctggcccctgccacgctgtgccgggtggtcttctgctcggtgcagctgagtgccagtcaaaggagagacgcgggagcacaatagagggcaggtgacacaatgccctcaaagggcgccagacattcctgagtgcggcagaggcccacgcgaggctcccatcagcagatgacaaggcccagaaatggtccagtcatgacggtgcagccctgcaccccactgctgtgccatcaaactgtcccggctccaggaaccaaccaggcttccccaccacagctgtggacaacacagcgaggggccactccactgtgaagaggatggggaaactgaggctgcccacaccctggctggctgcacgatgcttgcagggagaaaaactgcagatgggtcctgactcagacacactttccttacatggaaaagtttacagagatttacataaggcagaactaaaacttaaaaaaacaagaaatttctctcaacagcctcacatacaaatgctcttactggatacccaaagagagaagcgagggaaagtgctcttgtatatagagccccacagaaagggctgtgtccacaacagccagcagtgcaggggccggcagggccccaccctgagcggacaccagcattcccggccccatgggactggagagggggactgcggcgcccacacggcgtgaggaccaaggagcgaaacccacaccttctggagaatgatgcccagcactgcaccggcccacggctcactgcccctacccagtgccactccccttctgcaggccccccctgctctgagtgctcctcaccggcagccaacaccacctggcacgggaacacacggcccggccgaagctccgtgtagagcagtagtgcccagccccaacccaccaagggcaaggccctggcagcactcagcatacagcactcagcggccgaccaagcacccacacaggagcccggcaggcagactgggcatcctcaggccccgcacatgcctggacggggctatgacggatcctagcttggaatggggtcactcaccccagagctcggatgccctcagcaccccaagagcaggacccatcaagacccagggcctaggtcatgagcagccctgccctcccgaacttcccagagaccaccctgctcctccgcctggaggtgtggcacagagcaggtgctctgggagtccctgaatgactgatgcggggtaggagacctgctggctgccctttgtccagatacctctgacctccagggaagagccagtgggtcattgctgggccttgcccatcccctgcacagtgactaaatccctgagccactgctggctgccacaccccacggtgggctcctgtgtgcagtacaccctgaataatctagcacctcaccgctgtcatcatgcatggcctctgtgaagttcaagggtacccaggtgccttctcaaagatccctgctctgaagactgagcctcccacagagctgggagcctggctctgtcccagccacactgaggtggtctcacggataatgcagctgctatccaggcagtcacctgacgctcccagcccctggctttcaagcacacacatgcaaccaggcacatggatggccccaggaggagctgagtggcacgagtgtaaggtgcagtgtctcagctcgggcctccttccaattctcgccaattctaataagctgtcatagtctggcagtgccaggccaggattgcctgaggacaggagttcaagaccagcctggacaacatagcaagaccccatctccatttaaaaaaaaaaaaagtggctggacacggtggctcacgcctgtaatcccaacactttgggaggccgaggcgggcagatgacaacgtcaagagtccgagaccagcctggccaatatggtgaaaccctatctctactaaaaatacaagttagccaggcatggtggtgggcacctataatcccagctactcgggaggctgaggcaggagaatcgcttgaacccgggaggcagaggttgcagtgagccgagatggcaccactgcactccagcctgggcaacagagtaagactccatcaaaaaaaaaaaaaaaaaaaaagtaggagcctagtgctcacagtctcgcttggcaagggaagatagagtttacagttcagtggcttccgagccagccagacacgaggggccaagctgccaagagaagaggaagcaacttcaacaagcgagcagggcacagtgcacttagtccctttacggcagctgccgcccctggagccacaggcaccaggctgaggcccgccaagcccagaagtcagctctgaaaggcaaaagagccgagcaggaagttctgcagtcccgaggtgccaggaagggacacctgggtcctgccacgatccttcagccgggaaccaagacggaccagcagcaactggatcagagtgagctacctgcgtgctctctgcttgctcaagaaaagttaaattcccggccgggcgcgatggctcacgcctgtaatcccaacactttggaagggtgagatgggcggaccacgaggtcaggagatcgagaccatcctggctaacacggcgaaaccctgtctctactaaaaatacaaaaaatcagccggatgtggtggcgggcacctatagtcccagctacttgggagactgaggcaggagaatggcatgaacctgggaggcggagcttgcagtgagcagagatggtgccactgcattccagcctgggcaacagagtgagactctgtctcaaaaaaaaaaaaaaagaaaagttaaattccctctggatggaaaagtatccatcatctctgtaatattttagacctaatattccagcgattcaatgaaaaattaccaagcatgacaaaagacaagaccaaaggaacaaaaacaaaaagaaaatcaagataataaaaacagaaccacaaatgattcaactatttggcttatcaatgactttcacctaactatgaagaaatgaagaatcttaccaaagaactggactctaataaaaggagtcttagtgatggctcacatctataatcctagcacgttgggaggccaaggcaggagaatagcttctgcccaggagttcaagaccaggctgggcaacatagcaagacaccattctctacaaaaaataaagagcccaggagttcaagaccagcctgggcaacacagtgagacctcatctctataaaaaattgatggccaggcgcgattgctcacacctataatcccagcactttgggaggccgaggtgggcggatcacgaggtcaggatatcgggaccatcctggctaacacagtgaaacaccgtctctactaaaaatacaaaaaaaaattagccgggcatggtggcgggtgcctgtagtcccagctactcgggaagctgaggcaggagaatggcatgaacccgggaggcagagcatgcagtgagccgagattgtgccactgaactccagcctgggtgacagaatgagactccatctcaaaaaaaaaaaaaaaaaaaaaaaaattgagtgggtgtggtggcgcatacctgtagtcccaactactatggaggctgaggtgagaggattgctcgagcctgggaggtcaaggctgcagtgagctgtgactgcaccactgcactccagcctgggcaacacagcgatattccatctcttaaaaaaaaaattaagaagttagtagatgggttcaacacctgattagacacagcaaaagaaaggatgagcaaaagagagaaaggctaatatatggagtcccagaacaggaagagagagtggagcagaaactttatttgaaaagatactacccaagatgtctccaacgtagacaaaagacatcaagtcataagttctacttatccttttttttgttttttttttgtttgtttgtttttttagagacagggtctcactctgtcgcccaggctggaatgcactgatgcactgatgtcatcacagctcactgcagccttgacccctgggcttaagtgatcctcctgcctcagcctcctgagtagctgggactacaggtgtgcaccaccacacctggctaatttcttttattagcctaggctggtcctaaactcctggcctcaagtgatccacccacctcagcctcccaaagcgctgggattacacccataaactaccacacccagccaagtcacaaatccttgaacttctacaaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaatttatagcctcgagtgcttatgttagaaaaaacaggccagatacaatagctcacacctgtaatcccaacactttgggagtccaagatgagaagataactggaacccaggagtttgaggccagcctgggcaatacagtgagaccccatctctagtgcacctatggtcccggctactcgggatgctgaggcgagagagtcgcctgagccagggagttggaggttgcaacgagctagggtggtgccacagtggtacagcctgggagaacagagcaagaccctgtttctaaaaaattttaaaaaattaatcagtgttatttacgttaggtaacagattaaggggaaaatgtacatgaaaaaatcataccaataaatacattggtgtttgataaaattcagtatttttcatgacaaaaactcttggaaaattagaaagcaaggtaacatcctcaagctgataaagagtcctatacacaaaagtctaccgcagatacatagagcgaagggcagaaaacacccctcccaggacaggagagagccaggcacatctccctccccaggaccatgctgagtcctcggcatacaaaaggcaggacaaacagatgagaggtgtgtgggttagaaaggaagaaccaaggctgggcggggggttcacacctagaatcccagcactttgggagactgagggaggcagatcacttgagctcagaagtttgagaccagcttggacaatacagcaaaaccccgtcgccacaaaaagtacaaaaattagccaggggtggtggtgtatgcctgtagtccagctacacgggaggctgaggtgggaggatcgcttgagcctgggaggcagaagctgcagtgagccaagactgcgccactgcactccagcctgggtgatcaagtgagatcctgtctcatgaaaaaaatgaaaagaaagaagcagaactggcattatgagcagcagacacagttgtgtgcattaaaggagagactccaaaactcaaacagtaagatcgacaattgaatttggtaggaatgatgtattaataatgtcaacatacaaaactcagctaaacctctgctacgccagcaacaagacaccaccgacaaggggcccacatgggcccacgctgggtgtgccggtgtttccaggtcagcctttcggaagtctgaaatggcaacttttttttttttttgagacggggctcactctattgcctaggctggagtgtagtggtgcgatcatggctcactgcagcctcgacctcctgggttcaagcgatcctcccacctcagcctccccagtaggtgagaccacaggtacacaccaccagctggatttttttttttgttttctttttcttttgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggcagaggccttgctcccacgcgtggccaggcacgccatggaggctgaggctggcaggccatggaagctgggcatgctctttgcagacctacgtggggacaggtgatggcaccatccacagtgctggccccagggctctgacgccctctagggctcaccagcctgtcaccatcccaagatgccctctcacatgcaggcctagggcagcctggctggacaggaacaaatgtcaaagacccacaaaccagctgtgggcaaaagctgcaataacaagtcgagacacacagccaggaaaagcacactggccacaaactacctgctcgacaatggcagaggtgctcattccagctgagtctctgcccggcatgtccaggtcccgtgtctcagccctgctgcccacgcagcctccctgggctgggagccaggagcagactcaggcctagggtcagccgggccttgccagactcagtgggactcagcagcaccccgttcctcctccaggaatccgggactggctgtgtcagccaccaggctacggggccaagagaggaggtgtgtgtgcacagcccccggcactttcggggtgatagtggacacacctgaggatcgggcaacaatgaagggtgggcagaaggaggaataagcttggatgttcttaaatcaagcccttgttccttctgagagaggatttcttgtatccagccctgggctcagggcactggtcccacccatgggctggacgatacgataggaggatcctggggggcctctcctggggtgggggccatgcaccccacaacgtaagctcactgcacaggaccctccacgtcctgctgacggcagggtggaggtggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcggtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtccttagcagctttataaggtacaagtttgtgccacaaacctgcctgttcacagtgcaccgggcagtgggttttcgtaaatccccagagctgagcaaccaccaccaggatctaattttagaatgcgtgggggacacggggtggcttcctggatgctgccactgtgagcactgtgcgtgagcctcggtggggacacaggtactcttttcccttgggcacacacttagtaggaggatcgctggagcgtgtgggaactttgtggctaaaggtggtcctgccagactcagaggcagccccggcagtgccacaggactgctctccgtcctgcctgtcatcaccccatgaaggcccatgtcccagggcatctgtcccccccacaggaggcccagtgaggcagcagcatggacgtggttccaccccaccttgctgacgctggggtcccagtgccggcctgcaccctaggccctgctccacagcagtccccacacagctcctacaaacacaagggaggcagggccatgggctgaccctgggctctgctcagcttctcgctcaggaccttggtctgcttctaagagagcaggatcggagcaggcctctcagtgggaccccagggtggagccggggcaagcagacagcaggcggggcgggcagggacgcgggcgtgggctctgtctctcgccctgcagtgggctgcctgggcactctgcatcatccctgtccctaaaggcacacgtgtgctttaaacacttttacgcagaaatgacaaatttcaaaatgttgaaaggactttttttttttttttttgagacggagtctcactctgtagcccaggctggagtgcagtggcgcgatctcggctcactgcaagctccgcctcccgggttcccgccattctcctgcctcagcctcccgagtagctgggactacaggagcctgccaccacgcccggctaattttttttgtatttttagtacagacggggtttcatggtgttagacaggatggtctcgatctcctgacctcgtgatccgcccacctaggcctcccaaagtgctgggattacaggcgtgagccaccatgcccagcccaaatttcaaaatgttaaaaggacattttcagggttggatgcagtggctcatgcctataatcccagcactttgggaggccagggcgggtggatcacttgaggccaggagtttgagaccagcctggccaacatggggaaaccccatctctactaaaaatacaaaaaaattagccaggtatggtggtgcacacctgtaatcccagctactcgagaggctaaggcacaagaattgcttgaacctgggaggcagaggttgcagtaagctgagatactaccactgcactccagcctgggtgacagagcaagaccctgtctggaaaaaaaaaaaaaaagtaacattttaatgaaagatcctgatactgagggttgcctggccagaggcaccgtcagcaggctaccagctcgtcatctccaggagccctccctgcaccccactcaaaagagaagcaggccaccaggatcacctggcacccaggacacccctcgagggggaccaaccagaaaaacagaccaagacagaaaagagctcaaggtgagaagatgccacactcaggaagacgggagattataaaaaagattcggaaaagacccagagctcttagagatgaaaaacatgaaagaaatgaaacagcctgctggaagctaaagttcaggtgctgtcccaaagcaaaaagatagccacgtgcaaaaaaggatgagataacacatgggttcagtgtggcaggcagagtaacagagaagaagggagacacatctaacgacgaattcaacagaagctcaggacaggaagctgtcagagagcaaaggcctgatgggctcacactgccgtgagatttctgaacgtggagattagaggcaaggagctgaagccccgcagctgcacagcaagggccaggagccagagggccacagaactgcccagtgagaatgctggaggcaaggcgacggcaggggcgcaggctgggaggcagacatgtggccgggcacgccacgcccaccagacacagggcagggagggggaccaccttcagaggggcgcagctcggaaaaggtccctctcccagggagccattgcaggaggcacctcacaagatgaggagggtgtggaccaggaagcggggagtccccagagagcagggaaaagatgcaggtgcacagcaggtgtggacagcacagcacagagcagaggaggctggaaggctctgggctccctgtcaagaggccgaaggcagctcctgacccatgtgtgtgtctgcagatggcagcagtgggcacaggaccagatgcacagagaccagtgcaagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcaggcaccgacagaaccctcgctctgcatgcccaagggctgtgcgaggaaggcaggtgcccagctccccagttcttcgatccagtaaaaggagaccccaaattcagaaagccctggatcaactgaaacagttcttccagtaaggtgtttttctattaaagacaaacaccaagttactgcaactaccaagtcccaatattcgaggggagccaactaagcatcaagatggggccctctgggaggctctcaaaccaaaggatacgcggcgtgccctccgtacggcagaccaggtagaggcaggcagcaatcacgtgggccatcttccggccgcgggtcaggtgcctgctcacggccatcttgaagaagttgaaggcggtgtccaggcagtgctggttcagctgcagctggttccccaggtggtggatgtggcgcctccctaggacacagcacgaggcagctcttagccaaatgttcccacagaacatgaaaagtatcacacggccacagcagcaactttaagaatatagatttgtgcttttccttgtaagtttctgagctcactttttatatgtgggttccaatcactttttatttaaggacactgaaatgtgaattttctgtgatctccatgtgccatgagatcctgttctacctgtttcccttctttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctgggtcagcccacccgtcccttctcagcagggcccattctgctcagccctgcgcccgccagcctctcctctaagagccagccacccggcctgagaaaaagccaggctagcgccatcccctgcacctgcccagagggagggccatggtgtagggaaaaggaagagaggtcagactgttactgtgtctatgcagaaagggaagacataagagactccattttgacctgtgccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagctgcagggacctctgccctggaaagccgggtattgtccacggtttctccccatgtgatagtctgaaatatggcctcgtgggatgagaaagacctgaccgtcccccagcccgacacccgtgaagggtctgtgctgaggtggattggtaaaagaggaaggcctcttgcagttgagatacaggaaggcctctgtctcctgcctgcccctgggaactgaatgtctcgatataaaacccgattgtacacttgttcaattctgagataggagaaaaaccgccctatggcgggagattagacacgttggtagcaatactgccttgttattctttactccgctgagatgtttgggcggagagaaacataaatctggcctatgtgcacatccaggcatagtaccttcccttgaacttaattatgacacagattatttggttcacatgttttcttgctgaccttctccccactatcaccctgctctcctgccgcattcttcttgctgagatagtgaaaataataatcaataaaaactgagggaactcagagaccggtgccggtgcaggtccttggtatgctgagtgccggtcccctggccccactgttctttctctatactttgtctctgtgtcatttcttttctcagtctctcgtcccacctgacgagatatacccacaggtgtggaggggcaggccaccccttcaccatggtaagggcatgcccagcagaccggaggccactgcgccctcctaggggctgcgaggtgctggaggtggccaggacggcaacatccgagcacacgcgcctccctggagcaagaccctcccaaagctgcgggccacatgatggcatcaggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcacggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtcaagcctcacactgccaggcccctggcagtcagcagcatcacatggagcccccagcccggctgtggccctgccaccttgagcacctaaggccacctgcctagagctcatacagctctgaggcctgcagtccagctgagctgacgtggaaggctggtcactgtccccagagctgaggcctgggccaagccaagaccccaaaagaatggacagaaagggcatcgtgccagctgccacctgcacatgtgcagcaccagccagacacaccagcacagaccgtccccgcggcccagcaaggcccagagggaaacagagtcagctgacaggggacccgctgaagctacggctccttacctaccagctctctgctgtatgtttgaaaattctgtaataaaaggtaagagagaggtactctctgaggccacacacttgaggctgggactcgatcccaagccccgaccccacaggcaccagctcgtgttcccagcatgcagggctgctatggtcagaatgtctgactcctaaaattcctatgttgaaatcctatcccctacggggatggtattaagatgcagggcctttgcgggagactaggtcaggaggcagagcactaatgatgagctcagtgcccttaaaaaccggaccccagagaactagcccagctcttctaccacgtgaggccacagtgagaaggagctgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagctgagaggcggccctcactagagagctggggaggaggccacagtgagaaggagccgagaggcggccctcactagagagctggggaggaggccacagtgagaaggagctgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttaccatcttctttctcttttttgagatggagtctcgctctgtcacccaggctagagtgcagtggtgcgatctcagctcactgcaacctctgcttcccgggttcaagtgattctcctgcctcagcctcttgagtagctgggactacaggcacatgccactgcacccagctaattttttgtatttttagtacagacagggtttcacactgttggccaggatggtctcgaactcctgaccttgtgatccacccatctccgcctcccaaagtgctgggatacaagcatgagccactgtgcctggccaaatatgttattaataaacagatattcacatagaaaccaactactaattagctagccatagcctgcgagtctccttagacttccttccaacaaatgaattctaaaagtaaactcaggctgtgtgccgtggctcatgcctgtagtaatcccagcacttcgggaggctgaagcaggtagatcacttgagcccagaagttcaagaccagcctgggcaacatagtgagatccaactgctaaaataatcagccaggtgtggtggtgcaagcctgtaggcccagccaaggtaggaggactgcttgagcttggaaggttgaggctgcagtgagccatgatcctgccactgcagtccagcctgggcagcaagagagcgagaccctgtctccaaaaaaaaaaaaaaagatttgaggcatatcaccacttacatgtaaagtataaagcaataaagcttccagaggaaaacacaagagtatcttcagaccttggagtagataagaatttcttgaacaagtcacaaacagccctaaccataaaaactgatatactgggacttcattataattaagaaatttctggcagggtgcagtggctcacacctgtcatcccagcactttgggaggctgaggtgggaggatcactggagcccaggagttgaagaccaacctggccaacatggtgagacccccatctctatttaaaaaaaaaaaagaattggccgtgcgcagtggctcatgccggtaatcccaacactttgggaggccgaggcgggcagatcacgaggtcaagagatcgagaccatcctgaccaacatggtgaaaccccgtctctactaaaaagtacaaatattagccgggcatggtggtgcacacctgtaatcccagctactcgggaggctaaggcaggagaatcgcttgcacccatgaggcagaggctgcagtgagccgagatcgcgccactgcactccagtctggcaaaagagtgagactccatgtcaaagaaaaaaattaaaaatgagtggatgtggtggcatgtacacgtgatcccaactactcgggaggctgaagtgagagggcggctttagtctgggaggttgaggctgcaaggagcatcgactgcaccactgcactccagcccggaccacagagtgagtgagacccagtctcaaaaaaaaaaattcagaagtttctgttcgtcaaaagacaacattaagagagtgagacaagctacagacgtgggaggaggattcgaaacatgtatatccaacaaaggactcgaatccagaatatataaagaactctacaaatctgtaagaaaaagacaactcagtttttaaaaagcacaaaagacgccaataggcacttcacacagaaaggacgtcccaacagccaagaagcatgagcaaaggttgtggccataattactcaccagggaaagcgaattaatgccgcagcgagtgtgctacacacctaccagaaagactacaactggaaaggctgatgatgccacatgtgaacaaggctgcggagccactgggactctcctacactgcttcctggtgggaacatgaactggtacaagcactacagaaaaccctgtggccctatctaatgatgagcacacccagacctcaggacccagacacccattcgcaggtaaactcccaagcggagggggcacctgtgtccaccgaaggaccaggtgcaagaacacgcacagcagcttcctgtgcacagccaagaatggaaacaccctagacgtccatcaacaggaaaaggagataaactgtggtctattcatcccatgaaatactacattgcaataaaagaataaactacttacacgctccaaaacagcacgttctagaacggctccagcccagacactggcaagccagatgcggacgactagagccacaggagctctccttccttgctgctgggagcacaaaatggctcaggtgctttggaaaagggtttggcagtttcttacaaaactcagcatactctcaccacaccacccagcaatcactcagaaaaacctgcacgtgacgtttacagcagcttcactcataatcgcccaagcccagattcccttcagcaagcaggtgaaaggataaatcaactgtggcgcacctaggcggtggaatattactcaccactaaagagaaagaggccacaggctgtgcagagacctggaggacagttaaatgcccatggctgagtgacaggctgcacagagaaaggatgcacagtgtgcaactccagctctacgaccacatgaccaagcgccggtgaaaagatcaatggttgctggaggctggggaaggagggatgaatgggtggagctcaggggatctttaggactctgaaagcactctgtatgaaactgtaacagtggttacccgtcactacgcattcatctaaacccatagaacacgcaccgcccagcgtgagcctgggtgtgtggtggaagctgcgtgatcctgagcccaggtgtgcagatacagcctgaatgatcctgagcccgcgtgcgcaggtggaggctgcatgatcctgagcccgcgtgtgcaggtggaggctgtgtgatcctgagcctgcgtgtgcaggtggaggctgcatgatcctgagcccggctgtgcggtgaaggctgcgtgatcctgagtccgggtgtgcggatacagcccgcgtgaccctgagcccgggtgtgcggatatagcccacgtgaccctgagcctgggtgtgcaggtggaggctgcataatcttgagcccaggtgtgcaggtggaggctgcatgaccctgagcccgggtgtgtggatacagcccacgtgaccctgagcccaggtgtgcggatacagcctgcgtgaccctgagcccaggtgtgtggacagagcctgcgtgaccctgagcccaggtgtgtggacagagcctgcgtgaccctgagcccgggtgtgtggatacagcctgcgtgaccctgagcccaggtgtgtggatacagcctgcgtgaccctgagcccaggtgtgcggatacagcctgcgtgaccctgagcccaggtgtgtggatacagcctgcgtgaccctgagcccgggtgtgtggatacaggctgcgtgatcctgagcccaggtgtgcaggtggaggccgtgtgatcctgagcccgggtgtgtggatacagcctgcgtgatcctgagcccgggtgtgtggatacagcctgcgtgaccctgagcccgggtgtgtggatacagcctgtgtgatcctgagcccgggtgtgtggatacagcctgcgtgatcctgagcccaggtgtgcggatacagcctgtgtgaccctgagcccgggtgtgtggatacaggctgcgtgatcctgagcccaggtgtgaggtggaggccgtgtgatcctgagcccgggtgtgtggatacagcctgcgtgaccctgagcccaggtgtgcggatacagcctgcgtgaccctgagcccgggtgtgtggacagagcctgcgtgatcctgagcccgggtgtgtggacagagcctgcgtgatcctgatgagtcgatgtggggcggctgactgcagctcgtgcaccacagtggaggggggcactgacggggtcaggggaagctgtgtggtgggaggtgctcagagtctacaggaactctctgccgatccattttgctgtgaacctaaaatgctctaaaaattacaagtcttttttttttttttaaattcctttctatatgattcccactgtatgaagcagaaaaccaagtgaagccagtgggcagcaggtgctttctgagctgctgcaggcctgactcatgtggatttgtcaggtggttcatggaaggtcagcacatttcatgcactttactatgcgtgctatactaggaaaaacagaccaagagaacagaaaaagaatttccctgagaaacgcgtcccaaacgaaaggctcatcaggtcaatgaagagagccccacctagcggcatttcagaaccgtcgcttcagaacatcaaagaaatcatcccaaaaggcctgagattttaaaaacagagatcaaaacacactggcattcaacgtctcttgctggtggacccggagcagatgctccccacattccatggggtgcctgtctcaaccccttggcaaccatcccagggggaaggggcaggagtttctctctcccagaccctttctctaaatacagtctcagcgtgtccccagcaaaccaaaggaggggcctgtgacctcgcagggtgcacggaggcaagcagaggagacagagtcctcgcagaacatgactgtcgctgcgggcaggaagggtggcccgtgagtttatttccatctttgcagttttctaagaaaggcaatcaagacttcaccaaaacagtaacagtcggaagctacattcacagatttccaccaaacctggcaggctgggtggcgggcgggagtggaggccgtgggccaagcttgcagcgggaccagggctgatatgaaaacttcaaccaaggcggtatggggagaacaaaggagaataaacaaaatttaaacaaacataacccatgataaatcaatcaatcaaaataaagggttttttaaaagtaagataaatacagccaggtgtagtggctcacacctctaattcaagcactttgggaggccaaggcgggtggatcacctgaggtcaggagttcgagataagcctggccaacatggcaaaaccacgtctctactaaaaatacaaaaattagccgggcgtgatggtgggcacttgtaactccagctactcgggaggctgaggcaggagagtagcttgaacccaggaggcggaggttgcagtgagcccagatcgcgccactgcactccagcctgggtgacagagcgagactccatctcaaaaaacaaacaaacaaacaaaaggtaagataaatacgaaatacaaaataagaggcaggaagagcccaaagcatcagaaatgtgccagttataatgggccaaaatcccctcttgtgtctccagaagtatttgaaaaatacgttaggatctgcctcacagacatgctcccaggacactcgacagcaaggaggtacggcgggcccagccagccaaggcagaggaggacatcactgccacagcagggggcctgactggcagcaaaagggacgactccggcgaaaagtcagcaggaaacaggacaggggctggaccaatggcctccctcagccccacaccccacccaggcaggagcggtgcctggcccggggcaggcgggtgggagagctcactgagtgggcagcagggcatggcccctgatgctgcaggtacccaggctgcagctgcagaacctcaggtgggaacccaggtacaaagatcagcatagggtcccccagaaccacccatccccagtaagactcaagaggggtgggggccccgcagcttcccccacacagtgagtggggtccacggggcctcctgggcctgcaggtcacaaccttcactgacactcacccctaattagggagcatgtatgttccaattttcatttctttcttgaaccaaaggtatttaaaaggcttttgaaaaggtaagatgagccatttctctttctctgttgttggtttccaatcctattgcaatgcacgcgtctgcaccgacactactctttgcaatttgtataggtctgaggcacgaccaactctagtaaagataccgcgagtttttgggaaaatacagactacattctctgtggagaacaaagctcttcacatggagaaaatcttgaagtcagtagaagaaaaaaaggagatagcctagtggcaccacaagcaatgggcagagctgggccccaacccaggcagcctgaggtcaggagggcccctgggcagcgcagccccagcccccacctggaggaactgtaaacgtgtgtgccaggaagccctgaaacagacaaaacaaaaaactgacaaaactgtgggtaggacaggacggatccagtcactgtgccaggtcttcatgcacactctcggtggcagacacagagaaccagccagtggagaggaagagggatgtgctgcgctgcacccgcttcctgcaggaaacgcattcaagcgcccaacacacatgcacgtccacaaaactggccttccacccggccacggctcgaagcatttccgaagactgaaatcacacagagggtgctctctactgcagaagaatcacaccggcagtcaggaagaaaggcgctgactatactcctctactagtaagtccacagcaggacaaggaaaaaagcacaagggaagcgtaaggatccatccactctgctgtgagggatcatcgcaagcccaactacccctgccagcctaggtgtgtcggtgctggccacccgtcggcagcagcagccaggagcagaggcaggtgctcaagagcccggcctcctggagatggcccaggagaaaacagccagggtgacgtgctgtccacaagagatgttctacctgtcccgaccaccttccagcatccacactaaggctgcaggacatggctgcaccgatcacaagaatccctcacgtggtcctcaggttcctgagagtgtactcaatgaaacagtgaagccaaagagatcctagcacaaagtatccctgcctggactgacccacggccaacccacactcaatggtgaagactggatgcttccccaggatcaaggacaagaggatgtctgttcacaccactgctattcaatgtggtaaacaaaaaaaacaaaaacaaaaaacaggcactagactagaaaggaaagataacacgatcttgtaccgaaaatcctaagtgatccgctaaaaaactattcagcataaaaaatgagttcagccaggctgcaagatacaagatcaatacatatcaactgagactaaattcgacaaaagaagtacaaaacttatactctgagaactaataaaattgttgaaacaaattaaagaagacccaaataaatggaaagaaatcctgtattcaggtatcagaagactttacactgtttaggcggcagtgttccccaaaatgaccaacatattaacgcaatccccgtcaaaatcccagctgacttcttggcagaaactgacaagctgatcctaaaattcatattgccactcaagggacttcaaacaggcagcataacacttttgaaagagagcagttagaggactcacagttcctgatttcaaaactgactgcgaagcttcagtgtcctgaacagcgtggaacgggcaccaggactgtcatgcagtcactaagccaaactgaggatccagaaatgagcttttaggtttacggtcaatcgattttcagcaagggcaccaagaggatgccaactggcaaaatacagtgttttcaacacatggtcctgagaaaactgggtctgcacgtgcaggagtgaaggcaggcccttaccttacatcacatgcaaacgctgactcaatatggaccaaaacctactggaaagagaggaaggcgcaaaactccaaaaaatcataagcacaaatcttcacgatttggactggattaggcaacatttgttagttatgataccaaaagcacagccatcaagagactaaataggtaaactggatactatcagaatttaaaactttcatgctccaaaggataccagcgaaaaataaaaagacaaaagaaaatgaaaagaacgcatgaaatggctgaaaatgtcctataaatcacacatccgataaaagacttgtacctaaaacacataaaatcacacatccgataaacgacttgcacctaaaatatataaaatcacacatccgataaaagacttgtacctaaaacacataaagaactttttcaactcaatcataagacaaataacccagcagacatttctccagtttgtggtgaactggcactttgacaaaacgcagtgagaatgtcactacaatatccaactgctataaatgtgttatttctgcctccatctcactgaggccatcaagcaatggctgtggatcctgtgggatccactgggttctccccaaacagccctggcagagtctgcaggacacccaggaggggactcagggcacaattcctcctggaaagcagcctgggctgggcgtgcagggtgacgaggaagtggcaggccatgaggtccatggctgagtcagtgccctccaccctagcaccaccatccccatctctgggacccgccgcacgctcagcagcatccgcggtgggaaataccattctgcagggtctgcgctctcgactccttccccagattcacgtggaagccgccacccagagtcggggttttgccagcacctggaaacacaaaaaaagacagatcagccaaaacttggagatctgcatttacaaccctttcctaacatccacagacacaaagtgagaacaaagcgggggtcagcactcatgggggaagcagcaggtcggccccccgcacctccgtcactgagccaggaaccccagtgggggaagcatctctcactctgcccagccagcagggttgagggtgggccaactgcactttccgcattttctttttttttttgagacggagtctccctctgttgcccaggctggagtgcagtggtcccatctccactcactgcaagctccgcctcctgggttcacgccattctcctgcctcagccttccaagtagctgggactataggtgcccgccaccacgcccggctgggattacaggcactttctgcattttctaaccatgtccctaacacactgcaagtccagagtggacgctgtcaaatggctgccgggcgagaacacagatgtacctccaaacctctgcaagtggtgcacacacagcatgggctggccgtcccccttgccccaggccagcccactcagatatcactcctgcatggtgaccacatgtgaacacatccacctccctgctggactgcaggggacgcaggtaccatcccatgtgccccaaggcactgcaaccagccagtctgcagaaggcccccacgcctcagtccacccacccatggggaggctgcagctgaacctgctggacactctactccgaagctctgccaactgacagcatgcctacgacgtccaccacattctgccctgcagggcttcggggttaagacctggccctggtacctctggaaacatcaggtggacatttggattgttcaccaggttcaccagcccgatcgctgcagcctgatctcccaatgagcatggtggacatgtggattgttcaccaggttcaccaacccaaacgctgcggcctgatcttccaacgagaacagtaaggtgaggccccaggcatgcccaaagatggggagagctggaaagtgccccccgccccgcagcgtcggccctcagtggttggcacaggggccagtgcatttgtgacaaagcacagacacaggactggaggctgctgcaatcgggacgcgcagacaaccttggccacttgggggaaggcaagtgtgtagggcctgtcggaggacactggaaggataggatgcagaagcagaaagccaatcgctggagcctggggccaggccctccagggaaaccatgaggcagggacctcagcgtcatccaggggcagccaccagcacagacaaggcagaacaggcacggcctctggcttcacaatgaatgtaactgaatcccaaacaaatactaacaacactctttaaagactccagtaaaatgattctaaagttcagttggaagcaaaaaggaattagagcagccaagaaaagttttgaagagagcaaggggcagctactgggcccgtccggaaactcagagctgaacagggtcaggtggcactcagcttttcctggtggcagcagaggcaaagcccgggcctccttcaggctgaggcccagagccggcctcctggtgggtaacgtggccacaggggtggccggcagcagcagcagggcaccagcactgagcacaggcctccaacaaaggtggtgccgggacgggggcagtgcctggagactacctaggttgtcacaactgggatctatgtactagttttctgtggctgccataaaaattgccacaaacctagtggctttcaagaagctgtagaaggtccgggcgcggtggctcacgcttgtaatcccggcactttgggaggccgaggtgggtggatcacgaggtcaggagatcgagaccatcttggcgaacatggtgaaactctgtctctactaaaaatacaaaattagccaggcgtggtggcgggtgcctgtgatcccagctactcaggaggctgaggcaggagaatcgcttgaacccaggaggtggaggttgcagtgagcagagatggtgccactgcactccagcctgggtgacagagcaagactccgtctcaaaaaaataaaaataaaaataaaaataaaataaagtaaaaaagaagctggagtggtggccgggcatggtggctcacacctgtggtcccaacactttgggaggccggagcaggaagatcgcccaacccaggagttcaataccagcctgggcaacacggggagacccatttctttctttctttctttcttttttttttttttgaaacagagtttcgctctgtcacccaggctggagtgcagtggcgtgatcttggctcactgcaagctctgcctcctgggttcatgccattctcctgcctcagcctcccgagtagctgggactacaggtgcctgcaaccacgcccggctaattttttgtgtttttagtagagacggggtttcactgtgttagccaggatggggggagacccatttctacaaaaaaaaactgaaaaaaattagctgggtgtggtggcacctgcttgtggtcctactactcaggaggctgaggttggaggatcactagagcccgggaggtcgaggctgcaatgagctgagatcgtgccactgcactccagcctgggtgacagagcaagaccctgtctcaaaaaaaaaaaaaaaaagaagctagaacaggccaggcatagtggctcacatctgtaatcacagcactttgagaggctgaggcaggaagactgcttgagcccaggagttcaagaccagcctggacaacatagcaagatcccatctctacaaaaaaaaaatgagcggggtatggtagggcatgcctgtggtcccagctactcaggtggctgaggcaggcagatcgtttgagtccagaaggtggaggctgcagtgagctgtgatgcacctctgcactccagcctgagcaacacggtgagaacctgtctgaacaaataataaactaaacagaagctggagcaggtcgcagtggtgtctccttgtgggggctggagaggacctggcagggccacagtgaggtgcctgctgatatgagaatccagaagagaggccagggagaaacgcaggactcaggagagacccatcctggaataagggggctttgagcagcactgatgagccaattctaaattctgcagaaatctggcccaggcctccccaggctgagctccaggtgcctgcaactccgaccctccctcagagttctttgttttgtgagcagtgtgtattctttttttttttgagacggagtctcgctctatcgcccaggctggagtgtagtggtgcgatctcggctcactgcaacctccgcctcccggattcaagcaattctcctgcttcagcctcctgagtagctggaactacaggtgcgtgccaccacgcccagctgatttttgtatttttactagagatgaggtttcaccacgttggccaggctggccttgaattcccgacctcaagtgatccacccacctcggcctcccaaagtgctgggattacaggcgtgagccaccacgccccgcctgttttttctaagcgttcgaattaagatcaccattctgtgtagcccctggcatgctggtctccagcacatgctccctcaccaactttcactttagaaaaagaaaaatctcactatattctaattagtgtatataatgcttttaataaataactcatataacactacattagaaaaaggacaatgatcaaagtataaaaagccagctgggtgcagtggctcacgcctataaccccagcactttgggaggccgatgcggttggatcacctgaggttgggagttcgagaccagcctaaccaacaaggagaaaccccgtgtctactaaaaatatgaaattacccaggcatggtggcacatgcctgtaatcccagctactcaggaggctgaagcgggagaatcacttgaacctgggaggcagaggttgtggtgagccgagatcgcgccattgcactccagcctgggcaacaagagcgaaactccatctcaaaaacaaataaataaaaagcccctgaagccccaccttccaagaacaggggacgccgtacagcctccattatagccacgtttccctgcctaggtacagtgggctgcaggcgtgcttctgacagaacagggccacagtgagatgccacgttaaattacagtgatgatttcgattctggttgtgttttacgcaatctcttcactccttgacccatacccatcagcttgcaccacagcacactgcaaagctgcatgcgtcagcagctccacgctccacctgccacctctgccctccctcctccatcactctgtcttgcaccctccagcctcccataccctcctcacaccccaggacctctgtttcctgtccctgtgttgttctccctgtcccccaacaccacagtcaccctccctggggccacgctgctgcacctgctctggaagcgcctcctggcttctgcttgcctcacaccctggtgcgtgcacacttgcaggcacacacacacaggacacatgtggacagtgtgaaacctcagaacactaacccacagggaggatgaaagaggaaagtgccacctctggctgaaactgccaggatgccctctacttctaaaaacatttggtattttccatagcgtgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccgacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaaattagccaggcatggtggtgtgctcctgtagtcccagctactcgggaggctgaggcaggagaactgcttgaacccaggagatggaggttgcagtgagccaagactctgtcaaaaaaaaatttttttttaactggagactttctgttgctgctgtgaaacttcctttttttaagagacagggtctggccgggcgtggtggctcacgcctgtaatcccagcaccttcggaggccaaggcgggtggatcacctgaggtcaggagtttgagaccagcctggccaacatggcgaaaccccgtctctactaaaaacacaaaaattagccgggcatggtggcacatgcctgtaataccagctacttgggaggctgaggcaggaaaatcgcttgaacccgggaggcggaggctgcagtgagatgagattgcgccattgcactccagcctgggcaacaagagagacactccatctcaaaaagaaaaaaaaagaagtctcactctgtcacccaggctaaagcgcaggggcaccatcacggctcactgcagcctcaacctctcggactcaaggaatcctcccacctcagcctcccaaataggcgggaccacagacatgcgccaccacgcctagctaatgttttcttattttttgttttctttgtttgtttttttgaagacaagacagagtttcgctcctgtcgcccaggctggagtgtaatggcacgatcttggctcactgcaacctccacctcccgggttcaagcgattctcatgcctcagtctcccaagtagctgggattacaggcgcccaccaccatgcccagctaatttttgtattttggggttttttcttgttttgtttttttagtttttgtagagacagtttcactatgttgcccacgctggtctcaaactcttgacctcaagtgatcctcccaccttggtttcccaaaatcctgggattacaagcatgagctaccaaacctgactggaaacttcttttaaggggagacacctgtaggaggcctggctggctgggcagtaatggatggagaggaattcaggggtcccacaggtgagtgcccaaaggaggctggaccagaccgcagtgcatccctgagagctggggacggggacccgggaacacagagcgtgtgcctactggtggggctggatgcagtagcatcagacatctgggaggagcactgacaaacagggccaagcacggcagcccacaccccttcccaggcgcagacccttcccatgcgcacaccccttcccaggcacagacccttcccaggagcaaccctttcccaggcccacaccccttccccaggcccacatcccctccccaggtccagaccccttcccaagcccaggccccttccccaggccactgcggaggagctggttttgtagtgattacaatttggttacggaaaacaggacgtgtgtcacgctgcaggctaaccagcagcttcctccctcacccagatggcaacgggacagaattcacccgtttcctaagagcaggcaccttcagccacaacttagggttctgggggtcatggagcagaggcagaagcctggagccttccaccctcaggactagagccccgccaggaggccaggcgcatgctcagaaccccaggccgcagggagaggctggccggtcacatccttctctgaggcagagggagcttcccagcaggcgagggcaactccaccacccatgtccccctccagggccagcgccaggtgacatgcagccatgtcacaaattaggtccggctgcatcgtgaccccaaacggaaaacagcagcactcacggacaccccagcttcgaagttctaactgtgaagccactgaaagttgtgattacgggaaacgctccccacccccacaagttctggtgacactgaggtgtgctgctccttgcacaggacgaggagggacccctgcaagcaggagcccaggatgtctggtgtgtgggcgccatcaccatcacctgctggcagagggaagcctcagggcacacacagtgcaggacactgatgtgggctcacagggaagccccgccttgcctcagtggagcagacggcctcctcagggcactgccaacggcccccaactccaccgtctgcctggcccctccagccacgctgagcctcagtcctcacccacccttctctctgcacagtctctgctcgggtgccccgggacgctggagcaccagtgtggtttcccccgtggggcctggcttccaaggtcaggaccctctggggactctcctgaggcctctggtcacctgccctgatgccttagttaaatattccagagtaaactgcgaagctgtatcaggcttagttctcaattaataggcaaaacacctaggaaagacagtggccttgggactagaaaacgacagctcagagagaaagctcagctttcaagatgaagctggaggaaggggcggctggggcctacttgtgtgccagggaaactgagaagccaccaaggtttccagccccctgtgatcaccactgtgacgagggaggaaggatgccaagtgggcacctagagagcctgcctgggagacagaggggctgcccagagcaacagatcccctctctcctccccactctcggcccaggcaccacctgcgccggtccccaggggctaagaacccgccgcctcgcagcacttcccccaggaccaccacagttggttgctgggcctgcgcctccctccagagagtgtgcctgggctcagaggcgtcttggggccacctgacagcgctggctctgagcttgttctgacagcacccgggtgacagacttccagctctgcactgctccacaccaccatcctcccccggcagggcacagtgagggcagtgcgctgtcaccaggcccggatgcacttaacactgtgcctgcccgggaaaccctgcgtctgctgccatgacaacttgctttcattactgttgttatcatcccaacagacatccaagtcttggcaactgtgacacagctgcaaactctgtgcccagcagtcctaggaagatacccagggagtatgagcatggaagacgatggggagggaagagcaggagagaaaactcaatgaagcccaagccagttcttagaaaagatcaaaaacacggatcaacttctagcaagagagacaaagggaaaaaaagacacaaaacaccaacatctgaaaggaaaaaggaggccactgtggaccccgcagatatcaaaaggataagggaatgcttcgaacaactctctgggcaaattcaacaactaggtcaagtggaccaattcctcaacacaagcggctaattcaccccaggtgaaacacagcatcttaaatataactagaacctcagtgatgaaagaagccgaaaccacagtgcagaatcttctgagaaagaaagctttgggaccagatggctacgctggtgaattctaccaaacatttcagaaagaaagaacaccaactctacataatgtcttccagaaaatagaagaggaaacgtttcccaacccattccataaggagcagaaccctgatacccaagacaaggacgttacaggaaaaactacaggccaatatcccacgcaagcatcagcaggaaccctcaacagaacatccggcgctgagcaaagcagctcatgccgctaatcccagcactctgggaggccaaggtgggaggatgccttgaggtcagaagttcgagaccagcctgagcagcaaagcaagaccacatctctacaaaaaaaaaaaaaaaaaaaaaaaaattggcgttggctcacacctgtcatcctagaactttgagaggccaagacgggagaattacttgagcccaggagttccagacgagcctggtcaacatggcaaaaccccatctctacaagaaaaatacaaaaattagctgggtatagtagggcgcacctgtagtaccagcaactcaggaggctgagctgggagggtcactggagcccagggggttacgactgcagtaagccatgaccactgcactccagccagggtgactgagcaagaccctagaccctgtctccccaaccaaaaaaaaatttttttaattagctgggcatggtagtgcatgcccgtagtcctagctactctggagtctcaggtggaaggatctcttgaacccagaagttccaggctgcagtgacctgtgatcacaccactgcactccagtctgggcaacagtgagactttgtcccagaaaaaaaaaaaaaagctgggtgcggtggctcacgcctgtaatcccagaactttcaggggccaaggcaggtgtatcacttgagattagaagttcaagaccagcctcaccaacatggtgaaaccccatctctactacaaatacaaaaaccagccgggtatggtagtgggctcctatgtaatcccagctactcaggaggctgaggcaggagaatcgcttgaacccaggagggggaggttgcagtgagcccagattgcgccactgcactccagcctgggcaacagagcgacactctatctcaaaaaaaaaaaaaaaaaaaaaactcaaggagtgtattaaaaactcttaggggccaggtgtggtggctcacacctgtaatcccagcactttgggaggccaaggcgggtggatcgcctggccaacatggcaaaaccccatctctactaaaaatacaaaaactgcggccgggtgcaacagctcacacctgtaatcccaggactttgggaggccgaggtgggcggatcacgaggtcaggagattgagaccatccatgtaaccccgcctctgctaaaaatacaaaaaattagccgggcgtggtgctgggcgcctgtaatcccagctacttgggaggctcaggcaggagaatggcatgaacctgggaggcagagcttacagtgagccgagattgtgccactggactccagcctgggtgacagagcaagacgccgtctcaaaaaaaaaaacaaaaaacttagctgggtgcggtggcgggtgcctgtgatcccagctacttgggaggctgaggcaggagaatctcttgaacctgggaggcggagattgcagtgagccaagatggtgccactgcactccagcctgggcaacaagagcaagacaccagctcaaaaaaaaagaaaaaaaaaaaaaaacctcttagaacaagtaagtttagcaaagccataggaaacaggacaacacacagaaatcaaccatatttatataaacaagcaatgaagagttgaaaactaaattaaaaaaattccacttataataactcctaatagagcttaggtacacatctaaaaaatgtccagagggccaggcacggcagctcatgcctataattccagcactttgagaggctgaagtggggggggatcacttgaggtcaggagttcgagaccagcctggccaacatggtgaaaccctgtctctactaaaaatacaaaaattagccaggcgtggtggtgggctcctgtaatcacagctacttgggaggctgaggcacgagaatcgcttgaacccaagaggcagaggttgcagtgagccgaggttgcaccactgcactccagcctgagtgacagagcgagactccatctcaaaaaaaaagtccagaagctgtatgctgaaaactacccaacactgacagactatatcaaagaaaatctaaatgaatgcaaacatacactgtgttccatggactacaagattcaacatagaaaaaatgtcagctgggcacagtggctcccacctgtaatcccagcactttgggaggccgaagagggcggatcacgaggtcaggagttcgagaccagcctggccaatgtggtgaaaccccgtctctactaaaaaatatacaaaaattagctgggtgtggtggcgtgtgcctgcagtcccagctactcagaaggctgaggcagcagaatcacttgaactcgggaggcggagggtgcagtgagctcagatcgcgccactgcacttcagcgtgggtgacagggtgagactctgtctcaaaaaaagagaaagaaagaaaaaatgtcagctctccctaaatatatcaagaggtttaatgcaattccaatgaaaaccccaccaggacttttgtacaggttgaacatcccaaatccaaaaatctgagattataaatgctccaaaacggcccggtgcagtggctcacgctggtaaacccagcactttgggaggctgaggcaggtggatcacgaggtcaggagatcgaaaccatcccggctaacacggtgaaaccccgtctctactaaaaatacaaaaaattagccgggcgtggtggcggtcgcctgtagtcccagctacttgggaggctgaggcaggagaatggcgtgaagccaggaggcggagcttgcagtgagccgagatagtgccactgcactccagcatgggcagcaaagcgagactccgtctcaagaaaaaaataaaataaaaaataaatgctccaaaacatgaaactttttgagtatcaacacgatgctcaaaggaaatgctcactggagcatctcagatttcagatttttcgattagggatgcttaaccagtaattataatgcagatattccaaaatcagaaaactctggtatccaaaacacttctggtcccaagcatttcaggtaagaatatgtgacctgcagagatgcacaaacttactctaaaattaaaaagagaaagggaaattaatagccacaacaactttgaaaaggaagaacaaaggttgagggactcacaatatctgatttcaggacaatataacaggtatagtaaaaaagcgtgtgatgctgacaaaggaaaacggcacctgatcaacagggcaggacacaaggcccagagacagacctgcacggacggggcccagtgagcacagccgagggagcaaaggccttcagtctttcaacaaacggtgttgaaacaaggggacctccagataaacaatgagcctcagcctacaaagcacaccttatacaaaacatagatggaccacagatttaggccaggtgcggtggctcgcgcctgtaatcccagcactttgggaggctgaggcaggcggatcacttgaggtcaggtgttcaagaccagcctgacgaacagggtgaaaccctgtctctactaaaaatacaaaaattagccaagtgaggtggcgcacgcctgtaatcccaggtacttgggaggctgaggcacgagaatcacttgaacctgggaggcagaggttgcagtgaaacgagattgtgccactgcactccagcctgggccacagagcaagattctgtctcaaaaaaaaaaaaaaagttaaaacttctgctttgaggccgtgcgcagtggctcacgcctgtaatcccagcactttgggaggccgaggtaggcggatcacgaggtcaggagatcgagaccatcctggctatcacagtgaaaccccgtctccactaaaaaatacaaaaaaaattagccgggcatggtagtgggctcctgtagtcccagctactcgggaggctgaggcaggagaatggcgtgagcctgggaggcagagcttgcagtgagccgagatcgagccactgcactccagcctgggcaacagagcaagactccatctcaaaagaaaaaaaacttctgctttgaaaatcacatatacaacaaagggcttgtaactacaatccacaaagaactcccaaaactcaacaataagaaaacaacccaaataaaaaatgagagtcagggtgtggtggctcacgctgtaatcccagcaattcgggaggccaaggctggagtatcacttgagcccaggagtttgagaccagcctgggcaacatagagaccttgtctctactaaaaataaaataaaataaatgatcacagcatggtggcatgcacctgtagtctcagctactcaggaggttgaggcaggagaattgcctgagcctaggagttcaaggctgcagagagccatgactgggccattgcacaccagcctgggccacagagtgagatcctgtctcgagataaataaaaaaataagacttgagcacacatttcaacaaagaggattcgggcatggcaaataagcaccctaataaggttgaacatcactagccagtagagaaatacagaataccactatgatgagatgccacacacctgttagaacaaccgaaataaaaacatcgacaacaccaagtgctggtgaagatgtggggcaactggtgagaatgcataatggcacagccacatcacaaaacagttcatgacagtttcccatagagttacacatacagctaagttccccagagaaatgaaaacgtatgttcacacagagagctgcaaatgaatccttttagcagctctattcacaaccacctgaaactggccacagtccagctccttccacaggctggggtccatccccagcccgcaatactgcccatcactgaaacgtcccctccgaggcctgcagcagcctgagtggccctagggcatccgcccggtaaccaccaaggccaagggcagcagcaatcggattctaagtaccagacattgctgaaaacaaaactgcaggcacagagagtgacagtgaggggcagcttgaggggccttctgggctccccaggctctcttcaaccctccctgtgctggctgccctggcccacgcgtgtgtcgaggaagtccacgcacgccacgggggtccacaggcgcgcgaagaaggtctacattctcgccaaggggatccacactcgcgcccagacggcgcagaaccgcgcgccccgacagagcgtgcggtaccgaggcgctggtcccggccgcgccgtcaccgcctccagcccgcctaagccgcaccgagaaatccgcgcagcgccagcccgcgggactcaccgtccagggacacgaactggcccacggccgaggagccgccgccgctgctctccacgaactgcacctcggacacgatgatgttgtcctccagcactgagccgcaggcggtgcacaccgcgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccg

SEQ ID NO: 1338 - DNA, 91708 bp, Homo sapiens; identical to SEQ ID NO: 1337

SEQ ID NO: 1339 - DNA, 2553 bp, Homo sapiens
acgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataaca

SEQ ID NO: 1340 - DNA, 15278 bp, Homo sapiens
cctcaagccgcggtgtactccagcggccccctgtggcctctccatccgcggcgggtctgtccctccttctgtctccgggtgcccacgtaccccccacctccgaccgccgttcccgtgtaccccgcccccccgccgaaccccagagtgcccacggcctccagcgtgtgtcctgagccttcttcccccgtccctccgcggaccccggccgcgcagaccccgcctccccaccggagagggcgggcacgtaagggctccgggctgggcctggggcgaggcctgggccgcgtggaggggaggtctcagggtcggaagcggggctgtggcaagagctctgggcctttccttcgccccgggcgtagcaaggccgggccctgagagcgtgcccgcagtgctggctgagggctgatgcccctggaacgtttgagaaggctggcagaggcgtggagtccgtgcagcaggctgccgaaggctttccaggctcccggggtggggtcggcaggggcagagaggacagttcgggaggctggtgtggagaagagctgcggcgggagctgggggatccactccacccagaggggtcagtgatgcctgacctttggctggaaggtgaccctagcagaccgcgatactgccaccatctgcccccagggactcaggtattggtgggcacgtgggtggccttgtgggccccgccccacctccccctgctcctacccccagatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtaagcggaaggaaaccctggccgaggctactctcctgtccccagcccgcctgaggccgctgtctctgaaaactccaggctggtcgtgatgagcagcctcaggggagggctgagtggggactgatgagaaacagatggctggactcaggaggctctcttccccatggccctggacgagcaccaaggtggacctgcacccttcttgcttccagaaccgtgggccgctgggctctgtagagaggtcttccaaggccaggaaggaggcaaggcaacacacttcccttagctctccccagtgcctcccaccccaggctgaaggtggcaagaagcgggagggaaagcaaggtccccagggggggtggtgtcctcccaaccaggtggggcagctgtcaggagaaggatttgtcactgaaagttgaccaaaacaaaatagtgggagaggctctgctgtgattccccaaactggaagcatctcctggtctctctactgctggacagtgagctacaggcttgtgtcaggcccagtagtgagaatggtgggatatagctgttcagccttaggacgttctctgagggcagaggaagccagaaccccactcgtgtggttccacttttggaaggttcaaagccaggctgagagatggctctaggctgtggcgagatgggtgcaggggctcctgggcactggcaatgctttggcagctggcgctggtcatgcggccagttcagtgtggggagctcattgagccatgcacacaggcgtgtctgcgtgtgttcccagggctgcccgctgaggcccctttgtaccctctcagtcatgtccttcaggcccaaatgctttcaaaacccctatgatggtgtcaggtgctggggagtggggtgaccaaaccagcagatgcagtggcttttgggaggcgaacatctcatgacaggcaatccggactataaatacacataggtcacctgtctagtgagggccgctcaggaggagggccagggggtgtgaggcttctgtcctgcacagggctggggacagggcactatgtctgaaggggtagggatgtggatgcaggaggagtgtgtattggacccatatccagcaaggacacagggacccagtggctcttgggcaggggcagccaggctgtatttgtagttccaagagatggactggtggctatgggtaatggtggttgaggacaaggctgggaggcagaagagtgggctgaaggcctccaagggcaggcgagcagtgggagaattaggttgttggccaagggtggaaagaggtatgggtgcatctctgctgacgggcaggtttttagtttggggacagggaatcttccctaaaaaatgtgggtgcccagatgactttataggtgggcactcccaaacaagaaattagtcatcctcattgatgaagcttcacctgcccagagccacttctgatatggacctggtatcacccaataccagtgccagaagagaacagagggagaaaaggaaaaagagaaaatgatgtgccagtctacctgtgggcatagattgaaaaatcctgagtaagtactagaccaaatccaggagcacctgaaatgcagaatttcatagccgtaaggatgggtcctgcacacttccgcctgccaggagagcaggcacatgtctcttcacagctctgtcccagtgcttaggacagtgtctggcacatagtaggtgctcaatgaatgtatatggaataaatgaagttgtatgtaaataaaagaagattgtaacccaaggacaaaggaattttgaaatctgtaaataaagttcagtaacaacaggtggaaaatcacatgattatctcaatagatgttgaaaagtaatactaataaattccagtatctttccttaagaacaaaagaagtcgcagccataaaaaaggatgagttcatgtcctttgtagggacatggatgaagctggaaaccatcattctcagcaaactatcgcaaggacaaaaaaccagatgctgcatgttctcactcataggtgggaattgaacaatgacaacacttggacacaggaaggggaacatcacacaccggggactcttgtggggtggggggaggggggagggatagcattaggagatacacctaatgctaaatgacgagttaatgggtgcagcacaccaacatggcacatggatacatatgtaacaaacctgcatgttgtgcacatgtaccctagaacttaaaagtataatttaaaaaaaaccgaagtatagaaacctgtaggttctggataagatgggaagagatggacatctccatagcctgacggaggggagctctcaagagcttgcagtggccaccaatggaagtatttcagatgcaagcagatggatgcatggtaccactatgacgtcagaaaaatcgccaggtgcggtggctcatgcctgtaatcccaacaattcaggaggccgaggcaggcggatcacctgaggtcgagagttggagaccatcctggcaaatgggatgaaaccccgtctctattaaaaatacaaaaactagctgggcatggtggtgggtgcctataatcccagctacttgggaggctgaggcaggagaattgcttgaacctgggagttggaggatgcagtgagccgagattccgccaccacactccagcctgggcgacagagggagactgtctcaaaaaagtaaataaacagtattctggaaaccgaagcccttatagtaaatcaagaaaatgagatgtgtaaatatctgaaaagatgacaatcactatttgcatctaatatgttacctacttggaaaatccaatttaagaaacatgagtacagataaaagagggagtttggatatgtgatcaccattcacaacttttcaacacagtaaaaagcagaaaatggaatggaagcaaaggatactattcaacttagcaacaggaactatgaagttcttagaaataaacctgttattggccgggtgtggtggctcacgcctgtaatcccagcactttgggaggctggggcgggcagatcacaaggtctggagatcaagaccatcctggctaacacggtgaaaccccgtctctactaaaaaatacaaaaaaattagccgggcgtggtggcgggcgcctgtagtcccagctactcgggaggctgaggcaggagaatggcgtgaacccgggaggcggagcttgcagtgagacgagattgcgctactgcactccagcctgggcgacagagcgagactccgtctcaaaaaaaaaaaaaaaaaaagagaaacctgttgttcaattccttcatgaagaacactttacaatgttactgaatagcatgtagagctcctgatggagatggttatcatattggatgggcagatttcatatgtgtgtttttgagacagggtcttgctctgtcaccaggctggagtacagtggtatgatcacagtgttactggaaaagggatctccatctggaccccaagagagggtttttggatctcatgcaggaaggagtttgaggcgagctgcagagtgcagtgagaagagatcatttattgaaagccgctccactgcagagcagggcatcctcaacaagcaagcagaggaacagacctactttgtttttagtttttcttatatcgaggtcttatctatgtaaagaccaagctgtgcctacgtgtgggtgggctgacagcataacaatttattattctattgattaaaaggaaactattttacattttagtgtgcaagtacattaaagcatcactataattatcttgaaagcatatattattgtgggtgttgggacatctgaacttccttttctatgagtttgtccttgtaggcattaccaagctgcttccttagctgtaaacatcttaggtccgtggttgtgacctgtaaggaatgtgctctattagtctcaaggtggagttgaacataaaatgatgttatcctggctctcctagactcctgcttctctaatcacagctcactacagcctggacctcctggactccagctatcctcccacctcagcctcccaagtagctgggaccacagtggcatgccaccatgcctagctaattttaaaaaaatttttgcagagatggggtcttactgtgttgcctggtgtggtcttgaactgggctcatgtgatcctccagctttggggtcccaaagtgttaggattataggcatgagccattgcgcccagccagatttaacgttttaaacatgccaagcttcccaaaaacaattcagtgttttttaaaaaaacagacttcatgaatcttgaaaatttcattttaaatgtacatagtgattctggaaatgtattactagtttactttttaaaaaaaattacagacagggtctcactatgttacctaggctggtctctaactcctggccttcctaagagctgggatcacaggcatgagccaccatacccagcctttggcaatgtattggttatccattgctgcatgacaaatttccccagagcttagcaacttaaaacagtaagtatttttatcttagtttccgtaggtcagaaatttgggagctgcttagctggtggctttggtttgagatctctcaggagcttatagttgagatagcagtcaacacttcagtcatctcaaagcttgaggaaggctggagactgcttccacggcagctcactcacatgactggcgagtccatgataggggctggcaggaggctcagctccttaccacgtggatctccccataggacagcttcagtatcctcagtatgggggctggcttcccccagagtgagtgagtggagagagtgagctgaaagctgcaatgacttccatgacttaaccttggaagtcacactcctctctttctacagtatccgttttggatacactggtcatcctatttagtgtgagaggggacgacacaggggcatggataccaggaggtgaggatcattggatgccatcttggaggacagctctcacaggcagtcatttagtctatacgctttaagaaattatgtactgagaagcataatagtgaaattgtagaatgccagcgacaaaaacctcagaagcaatttgagtgggaagacagaaccttcaaagcagccacgggagctcgtcacagtagagcagtagcatgcctgtgctcaggggaagccatgctcagcctggaatagcaggcccagcaaaaatggattatacaaagggctaagtaaagtttttaaatgataaaaaagagaatttgcccccagcacactctcacctcagttctgaagaaatgatctcaaagcatcatgaaagtgatgaaaggtctgaaatggataaagcatgagaggaagtaggaagtgtctgagtaaactgaaactgacagtcactggatgtcactcatgcacagaaaagcaaggatacaatcaatatatgtacctgcaatggcataaatgtcaagatggtgcctgtgagtggaactaaagtgttctcagttcctctgagaagaggaggggggtgggccatggtggctcacacctgtaatcccagcactttgggaggcctaggtgggaggattgcttgagctcagcctggcaacatggcaaaaccccatctctataaaaaaatcacaaaaagttagccaggcatggtggcatgtacctgtagtgccagctacgtggaggctgaggcaggaggatcacttgtgtctgtgaggcggaaactgcagtgagctgagattgcaccaccacactccagcctgggcaacagagccagaccttgactcaaaaaaaaaaaaagatcgagttgcttgtcatctttggagttagatgagtttgcctgccctcacatattacagcagaagaacagaaggagatacgatggcagatagaatcgccggtacgtcatttaattcagtcaatgaaaacggactaagtgttccagttaaaagacagacattgtcagagtgggttgaaaacaaccaaattcagcggtagggttgtgaacgtgtgcagcggtaagcacaggaatattccaaccgcagggtgaagatggacaccaaacggccgtgcatcagttcacattgcatttttctgtcaaacagcaaacttacctcggatttgggaatgtggttgtgtggacgcctgttgcgtgcagccgtgagcgtgagtctcatagacctgttcctgagtgaaagaggcaaaaaggtgacaaaattattcatgccatgtggctttgttcagagttcaaaagcatgcagaagtaaacaagatattgccaatattcattaaagtataatttgaaaaaataaagatgttttaaaatgtttacttggaaaaggaaccatacaacaattttggaaaataagagcaaggcctggcttgtccgcaccagctccaacaactaaaactgtgtggccctgtggcagaaggtggcaaagacaccactgcctggacaagtaacccggaaaccaacctgtgcataaatgtggggatttaatttatgttgagcatggcatttcagagtagtgagaaacagacctttcaataagtggtattggggtgattggctgtatagttagaagacggtagagtgcgggtccgtctctcaaaaaaatgcacacacaaaaaacattaaacccaaaccatgtgagcactgagagagtatatgagagaatatttgggatctggaagtgataagtgcctttcgtaggccaaacacaaaatccttgaaggaaaagcctgacaaatctaactacagagtttttaaacatttctgtgcaatcaaagacacaaaaatgttaaacgacagcctggaagaaaatacttgtaatatttataacattcaaatgtttaccaaccagaatctatgaagagatgcttgaaagcaatgaggaaactatttttaaaactggatagaaaagtgggccaggcacagtggttcactgctgtaaatcccagcacttcaggaggccaaggcaggaggatcacttaaggccaggagttcaagaccagtctggacagcatagtgaaaccctatctctgcaaaaaataaaaattagcccgggtggcgtgccactgtaggctcccagctgctcgggaggcagaacaagaccctgtatctttaaaaaaaaggaggaaaaaaatgaattaagtctacgtacttgcagttcctaaaaaaaaaaaaaaggaactaaatgaaacagtgaaaaagttggcaaaaattataaaggtggatctatgtggagttggtgaggatgtaaggaaagagtaagtctgttttattggtttttcaaagagcccattgtgatcattattcaccatttttaaattttaatttagtcattaatctttcctaatttcatctttaagctttcagaccatttcttttgctgttctttttgtatcttttcaaataatttgcacggtcatggtttggggacctttttctaaagatgtatttaaagctccagcttctcgcagcacagctttgaccatacctcacgttttggtgtgtcctgatttcatcgttcgtttctcagccaccatgtctggctaatttcttaattttttttttttttttttgagacagtctcactctgtcacccaggctggagtgcagtggcgtgatcttggctcactgcagcctccacctcttgggttcaagcaattctcctgtctcagcctcctgagtagctgggattacaggtgcacaccaccatgcctggctaatcttttatattttagtaggcatggggtttcatcatgttgctcaggctggtctcgaactcctgagctcaggccattcacccaccttggcttcccaaagtgctgggattacaggcatgagccaccatgcccggccagtttcttaaatttttttagagatgggatctcactttgttgtctaggctagagtgcagcgtgtggcaccatgacggctcactgcagccttgaactcctagcctcaagtgatcctcccatctcagcctcccgaatagctgggactgtaggtacacgtcaccatgcccagctaattattttttgtagagatgaggtctccctatgttgcccaggctggtctcgaacttctctgctgaggtcaagccatcctgcctaggcctcccaaagtgttgggattacagacgagagccactgcactctgccattgtttctttctaaataaattggtatttcagtctttattttctttttcactcaggacttaattagaagggtgttttggaatgtccatatcaacaggagtgttttgttatccttttgctattaatttctaattgtgtcactttgtagttgcagaaccctgtgttatgggggtctgtctgcatgggggtccatctgtgttatgggggtctgtctgcatgggggtccatctgtgttatgggggtctgtctgcatgggggtctgtctgtgttatggggctctatctgcattggggtctattttgtttgtggccaattcatgtgcatgttgagcttgtttgggaagaacatggattctctatgagttaaagagttctgtgcatgttctcctgtgtctgttggattactcattacttaaatcttattttttttaaattttaaattacttttgttaaaacatatatatttagaacagcagtccccaaagccactctcagcccttgcagacgtcccaccgcatgctgaggtgagaagtgcacttttgccggtgcgctgcctccttttctttctttctttcttccttttttttttttttgaaacggagtctcactctatcaccaggctggagtgcagtggcgtgatcttggctcactgcaacctccgcctccggggttcaagtggttctcctgcctcagcctcccaagtagctgggactacaggcacccaccaccacacccagctaatttttgtgttttgtttgtttgttttttgtttttgagacagagtctcgctccatcacccagactggagtgcaatggcatgatcttggctcactgcaacctctgcctcctgggttcaagcaattctcctgccttagcttcccaagtagttgggattacaggtgcgtgccaccatgctgggctaatttttgtatttttagtagaaacagggtttcgccatgctgaccaggctggtctcaaactcctgacctctggtgatctgcccgcctcggcctcccaaaatgctgggattacaggcgtgagccaccgtgcccggccgcactgcctccttttcattcctctgtcttgcattctgtccatgccccaccgcagagacgaagggtgtagcgccccttccccatcctcccaccagcattctgtctactcagcagaaacccaattccactgttagctttacagtgaccatgtggcatcgtgaccgtgggatggccgtgttgcctttgtgctgttttccctggaggaaatcattgtgttcccccctcctccccctccccctcctcctgctcctcctcctcctcctccctcttctacgaactgattattctttcctaaaccttccaacaaatctaggactctcctctcacagacccctgtacattgggtcgtctggagctgtgttttctccttggcagtggccttcctggagccctggactgccagcaaccagcccagctggcagggccactgagtagccttccccactccctctcccctccccctacaatccgcctgcctcctgtctacaggaccccttgtttcctgggccccagcttgttctccttggtttatcctttgttttggtggagtacatctagcagcttcctccaaaagggttcagaggatgtgaaagtttttgagactctaaagatatgaaaatatctttattctgcctgtatgcttgaatgacaccttggttgggtgagatactaggtgggaaataattttctttcaggattttaaggctttgtccatcaccttctagcttgcagcgctgctgtgtggtggtgccctagactattaagacttcttcttcttctttttttttttttttttgagacagagtcttgcactgtcacccaggctggagtgcagtggtgcaatcctagctcactgtggccttgaactcctggggagttcaaggggatggagcgatcctccctcctcagcctcctgaagtgcttggattatagctactgtgcccagccaggattttcttacattttctgtttctttctcccttcctttctttctttcattcattctttctttcgttctttttctctctttctccttccttccttctttttctttctctctctcttttttttttttccagagtcttactctgtcacccaggctggagtgcagtggcaaaatcacagttcactgcagcctcagcctcctgggctcaagcaatctctgcctcagcctccccagtagcaaggactacaggcatgtgccactgaacttggctaattttttaatttttcttttgtagagatggggtctcacaggctggtttagaattcctggcctcaagcgatcctcctgccttgggctcccaaactgctgggattgcagatgtgaaccatggcgcctagcctccttaccttttttgtttgtttgtttgagacggagttttgctcttgttgcccaggctgaagtacaatggtgtgatctcggctcagtgcaacctccacctcccggattcaagcgattctcctgcctcagcctcttgagtagctgggattacaggcatgtgccaccacgcctggctaattttgtatttttagtagagatggggtttttccacgttggtcaggctagtctcgaactcctgacctcaggtgatctactcgcctcggcctcccaaaatgctgggattacaggcatgagccaccacacccggccagcctttttactttttaaggcttaataatattccattttctggatctgccacattttctttatccattgatccattgtggaaacctggattccttccacattttcgctattgtgaataatgaccactgctgtgttggagtgcgcacatctgtttgccttcctgccttcaactcttttgggtacataccccaaagcggaattgctggatcccatgcaattctgattttaatgttttgaggaatgagaattcacttcgggtttgcatgaatcccactcttagcatggcactgccttctctcccctctccccttccccctggtgagggaggtggaggatggtgaacctcaggctgagcagagtctggaggaaccgtctcctgcagcccacgtgggaagttccttcttgggggatagaggtcgtgctggggacctcacctgcttctggcctttccctgtggccctcccacagcttctccagctggtggtccctgccctccagtctcctgtaccctgccaggggccctcctccactggcgctggtcttttgtctatggattcatgatctttattttctcccgaactctctttatgatcatttcagaggggtctggggagaagggcagtctggagctggccttagtcctgcctttcctgaggcacgcatcagtgctcgagctccgggggttctcctgccggtcaagccgggggccggccgtgaggactaagcggtccacaggcagccctgctgtacatgaagcggggcaggtactgggttgggcggtgtcctggcacagatgactgtgcaaagccacagagggccacactgcctgaggccccgcgccgggagctggcgctggagcagcgggaggctgagcagacggcgctttagaaagcgcccgggggcgagctctgagggtcggcgggtgctgggtgggagcggcgaaggggagctggcgccgaggccctcgccgacccgctgccctgtcccccaggtgtgcgagccgccggaacgcaggcgcccgggccgccgctggagcgtcagcatcgacgagcgccggcggctggccacgctgggcggccgggagaggccgggcgccgccgggacccagctgcactgcagggtgcgcggggggcgggtcctccccgccccgtccccgccccgccccgcccctccgcctcgcctccctcgactcagtcccactgggccctttaccccggcgctcccgggccccgccgttgtccccttcccgcccctcgaggctccctgaccaccctcgcccgcaggacgtcgtgcagatggtagcccagctggtgtcggaggacgtggacaaggacgtgctccttccccacccgctgaggtccaccgagtccaccaacgccttccaggccttcctggcgcgcagtgcgcctttctggcataatgcgactttcgaggcctcgaggtcacccccttcctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctggaccaccagatacactacatgctggctgtgctgcccacctggcctgtaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattca

SEQ ID NO: 1341 - DNA, 5397 bp, Homo sapiens
cggacagccgggcaggcggggctgggcgcgggcggcggcggcccggaggagaacgggcggagggcgcgggccgaccgggcgcaccgaccatggcctccaaatgccccaagtgcgacaagaccgtgtacttcggtgagtgcgtgcccgctcccggcccgctcggtgcatcccgccgcccttcgcggccagtcccgcgccgcagagccgcggcgtaactcggggtgcgcccggccccggccccggaccgaggatgcgcgtcccggaggctggctggccgcgctgcccaagcggctaaagccaaagggtggggctgcgcgaaagcgggggcggtcacgcccgaaccccgaagcggcttgtgggggcggggcagggaccacccgggcggggcttgtggtgccccgggatgaggccagtgtttgggggagcgctcggggatccgcggacgcatcccggttcctcggacggcgccgggcggggcggggcagggcgtggctgtacgccccgggtgcgtcccgcgcgctcccgtgggcctgggccctttctcctggaccccctacacccgcttcccccgggaacaagtggccgggaacagtgacccccagctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtc

SEQ ID NO: 1342 - DNA, 9395 bp, Homo sapiens
tgggagagcgctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcggggtgaggagcgcagtcctcctactggcgccgtgaaggagatcgcgatgcgccggagggaaggaggctgcgggcggggaaggacggagggcgtgcggggagggagaggaggggcttgctggggggggggccccgaggcggggccgggagggccgcctggaagaggaggtcgggggcgaaggaggccgagaagaaaggtggggccgggacccctcgggctgcgcctctcgtgggcgtgtccagccagggctgggggtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcgtaagcggccccacagggcgccttccggagtctgcgcgctcccgcccggcggttgctaggttgccaaggggcgtgaggcgctgatgggtggggtctgagcgaggcggggtgtcgggtgtcgtgacgattgagcctgcaagggcggactctgcggtgttctccatatcaacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacaggtctcgggagcgcggtgattgggtacaggtctcggccagcgcggtgattgggcgcaggtcccagccggcgcggtgattgggcgctggacccggcccgtgccatgattgggctcaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgcca

SEQ ID NO: 1343 - DNA, 8001 bp, Homo sapiens
gttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgcca

SEQ ID NO: 1344 - DNA, 1869 bp, Homo sapiens
cagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcggtgagcgcgcccacaccggccccgcgaggaggcgccgccgacggggcgacgaggctggggaccgctcaggaggaccgggggcgctgggtccctggggcggcgccccagcctgaaaacgcctcagcctggcccgccgcctgccccgggatgagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctggggccgcgccccccagcgctaagtggaaacagacgcggaaaccgacgcccggggcgcgatcccgggcgcccgcctccctgccccgcgcccgcgcgccccgaggggagggaggaagtgggaagtcacccctgtccccgccgagaagggctgtcgcaggctccacccttgccaccgcagaggcccggggctgaaagcaggcagccaggcccaggccctgctgacctaagccgcgacccctgaccctcggcctcgccctctagccccacccagccttcaggagcaagattcccggccgcacccgaaagtgccccggggaccagcgaccccgcgctttgtttagttgtattggctctggggattggagatgttcccctcatggagggtgctgagaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgaggtaggtgggacccaccctggtggcaggggccaggggtgatggcaccccctcacggcccttctctttgcagcacgaaggcaaaccctactgcaaccacccctgctacgcagccatgtttgggcctaaaggtatgctcccgtcatccccaccccaccccaccccacagcctcctccaccccagcctgttgactttttccaccttctctgcaggctttgggcggggcggagccgagagccacactttcaagtaaaccaggtaggtaggaccccaccccctatcctgcctcctggttccaccctcgggatggggatgccccctcccagggaggcctgaccactcgtgggccccaaaggaggccgtggacgctgcactcacgtctgtgcctgtctctctctgcacaggtggtggagaccccatccttggctgcttgcagggccactgtccaggcaaatgccaggccttgtccccagatgcccagggctcccttgttgcccctaatgctctcagtaaacctgaacacttggaa

SEQ ID NO: 1345 - DNA, 9067 bp, Homo sapiens
ggccgggagggccgcctggaagaggaggtcgggggcgaaggaggccgagaagaaaggtggggccgggacccctcgggctgcgcctctcgtgggcgtgtccagccagggctgggggtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcgtaagcggccccacagggcgccttccggagtctgcgcgctcccgcccggcggttgctaggttgccaaggggcgtgaggcgctgatgggtggggtctgagcgaggcggggtgtcgggtgtcgtgacgattgagcctgcaagggcggactctgcggtgttctccatatcaacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacaggtctcgggagcgcggtgattgggtacaggtctcggccagcgcggtgattgggcgcaggtcccagccggcgcggtgattgggcgctggacccggcccgtgccatgattgggctcaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgcca

SEQ ID NO: 1346 - DNA, 8001 bp, Homo sapiens; identical to SEQ ID NO: 1343

SEQ ID NO: 1347 - DNA, 3588 bp, Homo sapiens
ggcgggcccgggagcggcgcagcatctgcgggcggcggggtaggcgcgggcgcgggcgggactggctgggtgcgcggctgcgtccgcggagggggcggcgggcctgggcgaccctgcacctctgggccgtggggactgtggggtggggcgggggccgatgcggcaggggtgaggcctggggccggcggggtgacggggacccggccctgcgtggggaagcctcggggggacaagcagagacgcagcctgctgggagcggcccaagctctgcaccggcccgcggcgggagcacagcagccccctcccgcccctcctcccgggggctccgaggggtggttatggggcgagggtccttgcggggcccgggcagtgaagggcctggaggccccagagtctgtgccaggtctgagccgcggggcgtggggggaggaggggcctcggccggggcccaggagacccaggacaggtgggcctggggccaggtccctacggagaggtggccgggccgggctctggcttgccggggtaggggctccgctaggggctggagtccgtcccttcgccagcgcagagcccctcggcccgcatctgccaagtgactgaggatcgagcgacagcgtagtggggcggaggggctggaggcacggccggaaagggtgagcggcgccgtggctcccccgctatttatttggccccgccacgcgcggagagggaggaaattctcaggctgcggctgcagctaggggaggcccaggtgggcctggaatgggcccagagagggcttcctgggtcagacgtgtagatccagtggacgtgaaaaccgggtgagtgtcccggtgggacccagagcgcggggaggcttggaggcaggggcatgggctgaggaccctcaaggcaccctcctcgcgacctgtcagagctccgaggggtgggggtgtcctgtgtgtggctgtggggatcctgggcggcgggtgctgggtgggggcaggggtgggagtgcagagttcaacgctttcccggatcggtggggcctgcggtgtcaccagggcagtccgagcgcccgactgtcacggggacattaaattttatgcctttgtctagacacggcagtaaacggagccccaggcctggggctgtggagggggtgaggggctggctgggagtaagcctgtcagtgactttggggtgggtgcgggtgtgcgggcctccattgtcacccaggtgtgcacaggcccaggtgcggggactccgacagcacggccatgaggaccagtgccaggtgtgtgacagaggtgcaggggcctgtggaagcccgacgggccttggtggacgggcttcccgagattcgagggcagccacaggcatcgccctggcgcagaggagcaaagcagggtggctctgccggggcagagggtgggggacaacacctcgccaaggcaatgcggagccatggggagcagggcaggcagtggccacgcgcccaggatggtggacaggaggggagaccgagcctgcccgtgcagggaggaggggcgtgggggctgccgggcaggggcggggaggctcggagaggcttgtgggacggatgcatcgggacctgggtggctctcggtccgggatcagaaagcctgggagggccgaggcctccttgggtactccaagagcggaggggcaggcccgcctccctgcccagtgcggcggcggggagagggtattcccggaactccgcggaaacggcctgaggccagcagcgcgggcgtggggtccgggccgccggagccaggagggagggcggcgcgggcccagcagtgacaaacccccccgggctccgggaacgagctcggcgggcagaaaacgcgtccgttccgtttccttcctggcggcgggaacgaggcccgggtgctctggcgaggcagcagcgccctctggaggcctcgctgtggttcgcggccgccggttcgcgcatgggcgcaggcgtgcgcgatgcctcggggccccggcgcggagaccgcgcctggtgggaagcacgcggggtgcggggggcggggggtgttgggggaggccgctccagcccgcaccctgatcttgtctcctccggtctccccaggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggcc

SEQ ID NO: 1348 - DNA, 5397 bp, Homo sapiens; identical to SEQ ID NO: 1341

SEQ ID NO: 1349 - DNA, 7234 bp, Homo sapiens
ctacccccatccactcttctggcagggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacaggtaggtctccgtgtccagcccacagcctccaagacacagggggaagggtgtccagagtcagctgcccccatagggcctgatcactgggcttctgggatctgcctgtctcccaggccgacgctcagctggggccagaaggctcagagaagggcccatggggacagagcaccaggaagcccgtgggtgcggaggttccccacctggggccaggctctacggggctctagggcggaggcactgtggtgaggcgtggtcaggcacgccctggttgggaggaggccagagtgggggtgtgggggtgcggtgactggcatgacccctcaatctcccgcctgacccctcgaggtcaggccctgggcccccaggcacgcagctggtcctgggcggtgcgggagaagggactggagtgtcagccccagcccggggcacagagggcacgcccactccttcccctccttcccttcctaactcctcaccgcctccccggccgccccctgggtggaagtgcttggggtggacgccttaagcgcggatccctcggcgctggtgcccgccgccccttccctgcctgggaggcagacgcagacctccccacaccccctaccagcagcttctcgagctgtttctggaggtggcggcgccttccttcctgagccctgccctccacccaaggagccttcagcaccacagacagtgttggggcggggcgcgggcgggggcggagcgggacatggagacccggacagggctgggggccgtgcccgccgggaatctgactccgctcccgcggcgcggctgttgctatggaaaccgagcaacaaagggaagcgggacaggcgccgcgcgcggcggggtgggggtggggttctcccggagcctgcgaccccttcccgcggcggagcgcagcctgggcgcccagggccgggagtgttggacccctaggcccaagtcactagggctccccgagagccgagggccaggctccccgcaccctgcccgccgccccggggacggcccggccaggcggccccgacgtcgccatggaaacagccggggcgcgggcggcgccgcggtcgcccgggcgggcccctgtagacgccacctccggcgcgaggggcccgggggcgccaggcctggcccggctgccccgcacccgccacccccggcaggtgcgccccgcccccgcggcgcccccaggcggcccccagcccgggggacgggttatcgaggccccgccccggccgcggagccaatgggcgcgcggacagccgggcaggcggggctgggcgcgggcggcggcggcccggaggagaacgggcggagggcgcgggccgaccgggcgcaccgaccatggcctccaaatgccccaagtgcgacaagaccgtgtacttcggtgagtgcgtgcccgctcccggcccgctcggtgcatcccgccgcccttcgcggccagtcccgcgccgcagagccgcggcgtaactcggggtgcgcccggccccggccccggaccgaggatgcgcgtcccggaggctggctggccgcgctgcccaagcggctaaagccaaagggtggggctgcgcgaaagcgggggcggtcacgcccgaaccccgaagcggcttgtgggggcggggcagggaccacccgggcggggcttgtggtgccccgggatgaggccagtgtttgggggagcgctcggggatccgcggacgcatcccggttcctcggacggcgccgggcggggcggggcagggcgtggctgtacgccccgggtgcgtcccgcgcgctcccgtgggcctgggccctttctcctggaccccctacacccgcttcccccgggaacaagtggccgggaacagtgacccccagctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtc

SEQ ID NO: 1350 - DNA, 7234 bp, Homo sapiens; identical to SEQ ID NO: 1349

SEQ ID NO: 1351 - DNA, 5397 bp, Homo sapiens; identical to SEQ ID NO: 1341

SEQ ID NO: 1352 - DNA, 5397 bp, Homo sapiens; identical to SEQ ID NO: 1341

SEQ ID NO: 1353 - DNA, 4313 bp, Homo sapiens
tagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtc

SEQ ID NO: 1354 - DNA, 2926 bp, Homo sapiens
cagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtc

SEQ ID NO: 1355 - DNA, 3232 bp, Homo sapiens
gctgggcttgtgatctacgttgcaggtgtaggtctgggtgcccaagctgctggagggcacggtcaccacgctgctgagggagtagagtcctgaggactgtaggacagccgggaaggtgtgcacgcttctggtcagggcccctgagttccacgacaccgtcaccggttcggggaagtagtccttgaccaggcagcccagggccgctgtgccctcagagacgctcctggaggagggcaccagggggaagaccgatgggcccttggtggaggctgcaagagaggtggtgccatgtgaccgcggtgtgggacagagctgggcccagggtgcagaggcccctcggttcttgtctatccgcgagggtccaggcagggtccagtgtctgggctcacgggcattgagtgtgcacctggctggtgccacctgcctcaccttagccccctccctgccccaaagccaaagtcaggcccggcctgccccagaaagcttgcaggactggtggccctgtggtgcccttctgcaggcacccctgcagcctagggggcggggctcggcagccaggtcagtgctttgtctcaaaaaaaacaaaaacaaaaacaaaaaacaaaacaaaacaaaaaacaaacaaataaaaagttgtaaaaggattgtggaaaagggatcttatgtggtcaaaggcggctgtgattggatttatttatttatttttttgagacagagtttcactcttgttgcctaagctggagtgcaatggtgtgatctcggttcactgcaacctctgcctcttgggttcaagcgattctcctgcctcagcctccagagtagctgggattacaggtgcccaccaccacgcccagctaatttttatagttttagtagagacaggggtttcaccacgttggccaggctggtctcgaactcctgacctcatgatccacccgcctaggcctcccaaagtgttgggattacaggcatgagccactgcacctggccggatttatttatttatttatttttgagacagggtcccactgtgttgcctaggcagcagtgcagtggcactcagcactgaggctgagggaggttgaggtgggagggctcaagcaatcctcccacctcagcctcccaagtagctgggactacgggcacgtgccaccatgcctggccaattttttttttgtattttttgtagagacagggcttccccatgttgcccaggctgatctcaaactcctgggcttaagtgatccaccctcctggaatgctgggactacaggtgtaagccaccttgcccagcctggatggaattatttataaggtttaattaaaattagctttaatattaacagttcatgtgaaactagaatttggtcttctctgttaaagtgacagttttctggaatattggtctgctcttcattatggcaggtttttcttttttttttttcaccttgaaaaatatatatttacaggaacaattccccattctctgggactctttagaaaaaaaaaaggtccattttggggaagcaaaacagtggagacgagtgtagcaccgtcccccaaatcaccaacccccaggtcccaaggcctgggctgggccagggctgacagggaagcccaggagtcttttgaacccactcttcctgcctagaatagagacaggacaggctttatgtcccccattcctccctcccacctccagggacattgaaagtgtcctttgtacctacctgtaggaaattggggggctgggagggagggaactgaaaatacacatttgttatcaaaaataaacatctgggggggaggcggcaggaagattccctcccaaatccctttcttcacacccaccccaccaaatataggaagagatgactccctctcccctattgaaaagccccatttaaaaatagattatactatcaaaatggcagcacgggagagacagggagacctggagtactggctggaggggcccccccagacaggaaccacccccacaaaacccctccatgggaggaaacaggcaggaccccagggagtttggcagacaaaggaatggcttctcagggggaagaagaacaaagggacattcctccctggccaaaaagttggttaaaaaaggataagctgtctgagagaaaggttggggaggtggaaatttctattccaagggtgtgattctgccttggccaagactcccaacccattaaatggtacaaattcttcctggaccccgagtatggccaggaataataaaacgaaactaacttctactcacatcctaaaatggacacagggctccctcatctccccacgggcaggccgaggaatgaagaaagaaaggtcgttctcaagtcagaccccgattgtcctgtcttggggaaaaaagcggggaggtgggggagacgtcctgaccaccctaataggttaggtcaggcgcttcccagtggccttcaaaaaataaataaataaaccgcccctaccattgaagtaggagacgtgtcagggcagccactgggggacggacagaaaagagagaaaagagagaagctgtggaagctgagtgttttctgtggaggagttaatgagagtcactcctgggagaaatccttcccaaggatccccaccccaccacaatcagagcatgagtctttcagttgaactgtgtttctccttgagagagcacggatggagggaccccagaaggggtggtggtgctggtggtggtcatggcctctgcggccctggcgagagcaccgcgggggtcgagaggccagccacgccgatggaagggatgtgcacctgggcgccgccactggacggaagctggcaggagagcttggccgggctgcggggcgcagcgggactcaggctgctccggaagtgaacgctgggaggcagcgagctgggtgtcagcagcgccggggtcaacgtgtgcgtaggaagcagggacagggtcagcgccggcctcggcgcctggaggccggagccagttcccgatcctggggtccgttcgggtcccggcgcacctagcaggctcgggctgagtggaagctctaggtcccggggcttccggcccttctgcggctgggagatctgagggctggaagccgcgtggccgcccgcctgccctgcggtgtccataaggacctcggcagccacgctggcacgccctcctgtggagggacttcaggctcggccttggcggtttctggcacgaaccctctct

SEQ ID NO: 1356 - DNA, 128321 bp, Homo sapiens
gaatgagagcgctcgctgtgctgtctgtcacgctggttatggcctgcacagaagccttcttccccttcatctcgagagggaaagaactcctttggggtaagtagcaaacacattgcggtcttctggccttataaagttatttttcacacttactaaaatagagggcataatggtagctcctgagagtcactttaggcccctgtagtgtatgctttgttatgcttaagaaaaaaaaattgtaattcttgattttagaaggattgaaatatgtacatttctttctttaaaaaagagctgattttccttggatgacacaatagacaattttcacttttacctattcatataactgaaaaaaaaattctttgggagtgtttttcttcctttgctacagaattattttttattaaataacttctgtgatgtattttctggaatcagtgtgctactatgtgaaaacaagttaagaaagctactgagatgcagtggttaaaataatcacagatcaagctctttgcttttcttttaataaaataaataaagttccaaaccctgagaacaagtttcactggagtgaatactgcaggggcatttgcctggacattttaccccatggacaccgctggccccgggagcaggtgacacctcgctgggcaggtccctgggcctctgcacacagtcccggggcccctggagcaggtgacacctcgccgggcaggtccctgggcctctggacacagtcccagggcccctggagcaggtgacacctcgccgggcaggtccctgggcctctgcacacagtcccggggcccctggagcaggtgacacctcaccgggcaggtccctgggcctctggacacagtcccggggcccctggagcaggtgacacctcactgggcaggtccctgggcctctgcacacagtcccggggcccctggagcaggtgacacttcgccgggcaggtccctgggcctctggacacagtctcggggcccctggagcaggtgacagctcaccgggcaggtccctgggcctctgcacacagtcccggggcccctggagcaggtgacacctcgctgggcaggtccctgggcctctgcacatagtcccggggcccctggagcaggtgacaccttgccgggcaggtccctgggtctctggacacagtcttggggcccctggagcaggtgacacctcactgggcaggtccctgggcctctgcacatagtcccggagcccctggagcaggtgacaccttgccgggcaggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgcccgctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatgctagatgttcagccaatggtttgtaaattaattactttgttattttatttcatatttagtaggacctggttgtataaaaccagagtaaaacatgttagaagtcaagagctagttctgagcaagttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatgagttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcacccttatgtgtcaggcacccattttatagatcaaaacgtagaggtctggaagtctcagaagcagcaaggctgtggccgctcagtctcacagtctcacgtcccaggtctttacagagaaccaacacacatcctcatacttgaagctcgatgataagtactcagcgaaaagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcagtcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtattaggccagtgccgtgactcacatctgcaatcccaacacagtatcaggccagtgccatgactcacatctgcaatcccaacactttgggaggccgaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaaaagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaacacacaactctaaacaggaatcaagcgcttagaattaggagcaaagctctggccctgggggcttatggttttggagaagaaagattttggctttcatatatatatttaacataaacagcctttggaacaaggcaacttccttcttctttctgaaatgtggtatgttcttgcctaatgtgtccctgaattccacctcttttatgaacaatatgaatatgcataaaggagaatttgggggaaccgtgccatgcgcccctcagagcaggagcaatcttgagaaggcgcaggcagagagcagcgggcggcttctccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccgcaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaatgattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttgagactatctgatgagagttatgtgtctctgggaggaagttttcaatacagaaatggatttattttatgaaacttaaaagactaataatctgcaagcctataagaatgttttaattctgtaaaatattttacaataagaaaagaaactagagactaagcaacatatgatcagttaaacttgaataacaatatattaatattggtcaataacaaggaatgatctctctagtaactgccgtttccaagcatagtagagaaggataagcatgtttctttatatttaatcagttggttcttaaataattgtcaagtgcctgctgaaaaccagcctttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagccttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaacacccctcaacagggaacagaggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggaggttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgccccagggagccccacaccggggggctctgttcattgctctctgcccaaccctgaggggtcaccctctgccccaagtgcttaaccactggttactcatcccagaacccaagagagatccagcacggaggttttcttaactttgctgtatcacactgtaagaaactgggtggccaatggaacagacggagcagggcagagtgagcaggaagaaatgatgctggggaatttgtgtgctccttgggtggggacgagcatggaaggcgcgtgggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacggtgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagcggggaagtgaaggcctgtggagggaagcgaccccgggacctggctgcctgcctgtcccggaagccacgtgggcatcaccgcagcaagatgggcttgaggaacaaagcaacactgtcagtgaatcgctgaactgtcattgcgctttgactgtgtgacattctgttccgtaggaaagcctgaggagtctcgtgtctctagcgtcttggaggaaagcaagcgcctggtggacaccgccatgtacgccacgatgcagaggtgagccttgcggaggggccgccgccccaaatgccaccgacaggcgcatcctccctgacatccacacacgtgtggcctgattttcgcaattgcagatgaaaacctgaagcttgccattgttaatttacttccccagtgtcatgtgcaagcagcagacagaactggtatttaatctccaatcctttcttaagcaagacacaaaggaggagcaccctgatgcaattagcaattacgtataccctggttaaaagacagtagaggctgacgtcctgatagcaaaaccagcctctcttctccaggattaggacagattaaggaggaaaagagagacctagatcccagatctttggtgttgtgatataactgtaacattacctgtggcatagaataaagaattaaatggggctctcccccatttttgaaataattagcatttgtaattatataacagacaccactattaagaatattgtggtctcatattacctgtctagaaaaagaaaagaaaaacaaaaaacaaaaaacctgtaaagcagtttgccctcccaagcttattattttgtaggaagttgactaataattatataagttcttgagatacaaaatatcaaaagacagcagttaatttattccaaatttctattattccagccagaaaaataccttactgttcatattggctgcaaacaaattattatttattttctaaaaattgaatcaaagggaaaagaaagagaaacactatttctcataaactcacgcacactttaatatgtctaaaatgggcaggaattcctggggaagacatggcagtgggggtggataccaagtgcgtagtaagaagtgtgtgctgctctcttagtaacaatttgtgaacccaagtatctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgagcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatcaactggggagactattggaaagatttgccttttgatagctctcaaaaaaatacactatactatacacctattccaactatgtttctttccttaagaaatactgtttctactgtggaacagtcattgttctagatgccgggatacagagatgagttcgatcatttcatatcctcagaagtccgtgctccttctgtaaagtcattgttctagatgccgggatacagagatgcgttagatcatttcatatcctcagaagtctatgctccttctgtaaagtcatttttctagatgttgggatacagagatgagtttgatcatttcatatcctcagaagtccatgctccctctataaagtcattgttctagatgccgggatacagagatgagtttgatcatttcatatcctcagaagtccgtgccccttctgtaaagtcattgttctggatgctgggatacagagatgagtttgattatttcatatcctcaaaagtctgagctccttctatgcagtcattgttctagatgccgggatacagagatgagttagattatttcatattctcagaagtccatgctccttctgtaaagtcatgttctagatgccaggatacagagatgagttcgatcatttcatattctcagaagtctatgctcctcctgtaaactcattgttctagatgccgggatacagagatgagttagatcatttcatattctcagaagtccatgcccgttctgtgcagtcatttttctagatgtcgggatacagagatgcgttagatcatttcatattctcagaagtccgtgccccttctgtaaagtcattgttctagataccgggatacagagatgcgttagatcatttcatatcctcagaagtccgtactccttctgtaaagtcatcgttctagatgccgggatacagagatgagtttgatcatttcatatcctcaaaagtctgagctccttctatgcagtcattgttctagatgccaggatacagagatgcattagatcatttcatatcctcagaagtctatgctccttctgtaaagtcattgttctagatgctgggatacagagatgagttatatcattttctatcctcagaagtctgtactccttctgtaaagtcattgttctagatgccgggatacagagatgcgttagatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctataaagtcattgttctagatgccaggatacagagatgagttcgatcatttcatattctcagaagtccgtgctccttccataaagtcatttttctagatgccgggatacagagatgagtttgatcatttcatatcctcagaagtccatgcttcttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttgttggttggagaactgacttactttgagtaaaagttttaataataataaaatacttttatccttcaaaacacatctagttactttagagccgaaaaggaaaaaaaataacttttctaaataataatatccaaaactagagtgtgcctaaatcatttcttccactcactcatggacagtggtatggccctaggcttttggaaagtgataggaaagcacagagcctgcctacggaagtgtttacgaaaagggagagtctgagaccaccctaccccctcattcatcacttcacttacctggatagcatggggccagggacaaagggactttgctcccaaggtagatggggccagagttttagtgtttacgctcattccctgagaccagctcccatagagcaatggaaaggagaccagggcaggctgcacacagaaggggccacatctggggaggggggccctgtgcctggggacccagatctttatgatgtgcagtgagcttgccggcccaggctctggggaagagcatccctgtttgactggagagtgcagtgtgttctgaaggaagatatgatgtccagggaggcaggggagggttctggggcctgcggcccaggctgcatcagcaaccaggttcacctgcagcagccagaccctgtgagggaggcaggcattgtgtctgggccacctggccaggtgtggctggtagtgagtggccccatgagtgtgtgggggtgagggtgagtgtgcccttgacctggcaggcacccctcggacagggcagtgtgcttttctcccaccatggcaaagagcgggcactgcagatctgctccctccacctgccgtgagagtgggagcaactgtctccctttctccgcttcataattttataatttcggcatggacagaagaagcgtctgcatgaggaggctgtgggtccgggagaccagaggccgaggaaccaaatgctcccatcagtctcagttgctcaccccatgatctgtctgggctcacactccttgagcagtaaattcattcccttttagcattcagggaccatttccaatattcacaatttgctgtgagttccagggtgtattcagcctggaatatctgcatctagattggtgataccatttgagtctgtttactgttcacggtgaaacactctgggcattactgggatgacagacagaagagctaaaggagtgttattatttaatcaaatgaagctattggatgatgtccccaaaccgagagcgatccagagaattcgtgggaacatacatttgatgcatggctctgtgtgggctcttcacattaagaatgcgaaaccagctagagtcaaagtttccctaatttgagtttgattttcagatattttgctgcaattaagagcctgaaagtgtcacctattaataccttgcttatgttctgaagctgaggtcttaaagtaacatgcagccctgggctgggctgcaaactgtctgcattcggaatgacccatggctggggcccctgggaaatagcagcagatgaacagagcagactgtggcttgtggggtggttgaagcacctttccaggctctcctgaactgagctccccacaggctgggctctgcagaacatggacatgacgggaaagtgaccagccagcaagggagagtcctctgagctacacggcagttgcagggacaggaagggctggcatgggcagcatggcctggggacctatccgggggatccactgggtgataccctccacgtcactgtcaagagctgagctcagtttcccagacccctgctttcctgacgtaccccttttgggcccagattgtgttgtcccatgggtgccaggcaaaagaagggatgagacaggtgagccctcgagtgggtgcaggtgatgttctaggaagcagagaaagtggatttcatcaaaaggagcacccttggccttcagatctccagagaattcttgttcttcctattagccaaatgtcttgctcagatagattttagataaatgtctccaaggaaagcacgcgttttggggagggttgctatcctgtctaccatggcgagtcctggggaacctgcacaggtgcttacactctggctctgctgctgctgtgactgacaatgtcacttgtgtctgggccgagagtctcctgtctttggctggcatccatgaactatggctggctaatgtgttagttgtaagtagctataatctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagtgaaggccaggctgacatggtctcagatggaaatgaggaacttactgggaactggaggtagaggccgcctgtgctatgcctcagcaaagagcttggctgcattgtgtccaagtcgtgggcatctatggaaatttgaacttacgagtgatgacttggagtatctggcagaagaaatttctatgcagcaaagaattcaaggggtggtctggcttcttctaacaaccaaccatcagatatgagagcaaagaaatgatttgtatttggaaattatatttaaaagggaagcagagcataaacatttggaaaatttgcaggctagccacttgatagaaaacaatatcctgttttcagggaaagaattaaagggggttgttggagtaaccatttactagagagattagcatgactaaaagggagccaagtgctactatccaagacaacaggaaaagggcctcgaagaaagcatggtataagtcctcaggacagcccttactgtaacaaggccagagatctaggaggaaagaatgacttcagagtctagaccttgggcctctttgtcctgtgcagcccagggacactgatccctgtatcccagctactctggctctgggcttggctcagaggggcccaggtactactcaagccacagcttgaacagtccaagccgtaagtgtctatagctttcacacggtgttcagccttcaggctcacagaatgcaggagttaaggaggcttagtagcttcccctagatttcagagaatccatgaaaaagcctagtgcccaggtagaagcctacttcaggggcaaagccctctcagaatgactctactagggccatgctgagggggaatgtgaggttgaagcccccacacagagtgcccactgagacactgcttaatggagctgtgggaagggggccatcgccctgcagaccccagaattgtagatccaccagcagcttgcactctgcaactgaaaaagcctcaagtgctcaactccaacccatgagagcagccaggtgggctgtgttcagggaagccacaggggcagagctgcccaaggctatgggagcccattcctcacaccagggtacaggacacggagtcaaaggagattgtttcagagctttaagatttaatgaattgcctgctgagtgtagactggtgtggggcctatcaagccttcctgttggctgatttctcccttttagaatggaaaaatatacccaatgctggtgcccccattgtatcttggaaacatataactgcttttttatctcagaggctcataggtagaaggacctcatctccagatgagactttggacttgggattttgagttaatgccagaataaattaagactttgggggactgttgcgaatgcgcaattgtattttggaatgtgagaaaggtgtgggatttgggggaacgggtagaataataaggtgtagatgcttttcccccttaaatctcatgttaaaatgtgattctggatgttggaggtgaggcctggtgagaggcgattggatcacaagggcaaatccctgatgaatggtttagccccatcctcttggtgatgagtcagttcttgcccaggaagtccatgtgagacctggttgttttacgttgtgtggcacctgcccgcttgacctcttgctccttctctcaccatgtgagacacctgctcctgctgcaccttccaccatgactgtggcttcctgaggtctccccagaagccaagcagatcctgggtccatgtttgcacagcccgcagaaccttgagccaattaaatcccttttccttatgaattacccattctcaggtatttctttacagcaatgcaaaaaataggttaacaagtaagctttttaaaaatttatttttattgtatgtatttccgatgtgcaaaatgatgttttgatatacaaatacataatgaaatgatcactaccgtcaaacaaagttaacatacccatcaccttccgtagtgattggtgtgtacatgtggtgagagcacttaaaatctctcttagcacattagtttttagtattcaatattattaactacggaaggaatacaagtgcttagcacagcacctaaaactttattttcactcagtaagcactatgtattttggggttattattaataaacaaaaatataaacaatgcatttaattatggcagaacaactgaagagaacaactaggtcacttttcccaaagccacagtaggtgattctgagccctgagcctcatgtctaacttgcagagggaaggaggttctcctgccagctctgtagttctgtctggcgtctgacactcgcacacctgccaacacctccccaactctactctcttgctcctgctcttgctctaggacctgtccactcacacacctgccgtggtcacttgggcagtgctggcctcctgtcagctggagaggccccgccctgcaggcgactcagccagggcagctgtctggagcccccagagcacagtccgctgtggtcactctgcttcttctttgaggcctggccctgccagctttgctgccaaaggtgattgactcaacattcagacaagaaggatggtgaacttgatgtagtcctcccttgggtcctggggactcagtaattccattctgcaggtgcctggacaatgctctgatccacccaggtgttggcagcattgttgcaaaggtcacctctgtgctttctctccaggttccccaggtcctcaaatgctagtaggcaagccagttgtgaaaccttggattggttccgtgtagctgctgctgctgagaatctaaaaaggccaggtgcttgtgtgggagaccaggagtaaggggaggcctgcaggtgaggggaggccccaggtgtggagaggcctgcaggtgaggggaggcctgcaggtgaggagaggcctgcaggtggggtgaggcctgcaggtgaggagaggcctgcaggtggggtgaggcctgcaggtgaggggaggcctgcaggtgaggggaggcctgcaggtgaggagaggcctgcaggtggggtgaggcctgcaggtggggtgaggcctgcaggtgaggtgaggccccaggtaaggagaggcctgcaggtgaggggaggcctgcaggtgaggagaggcctgcaggtgaggggaggcatgcaggtggggtgaggcctgcaggtgaggagaggcctgcaggtgaggagaggcctgcaggtgaggggaggccccagatgaggagaggcattcagatgaggcaggcttcacatatttcttattctatgagggtgtgtttagctctcactgtgaacagctttgctgccccgttctagggctgcattgagccaatgctctgcactggagtgggaagggaagaagttggagctgggacacatgcagcttctgcaggctttggctctgagatcagggcagggctgtgcgcttcccagtctcctgtttcattagctgggatgtaaacaaatcatatcttggtttggatgtgatggcctgtccgcaattgttatgagaatccaattcattctgatttggcagttttgtaaagggcaagtctgtgccattttcctcatcattcaatactgatgcatcacttacaccctattcctgttcctaaacccagtgaccccgtggacagcaactgcacatgttttacctgtgcacaccccgcagtgcctgtcacattgtctgggacacagtagttactcaataaatgtctgcttaattaattagtaattaagtaccaaagataccatagacaaataatctattttatatcttctttatgtgccatagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacgggtaatgtgtgcccctctccccactgaggagcggcaactcccgaaggaggacaccttgactttgtgcaggggctgcttgctcagggcatgttttttacttgagaccaagcaggatgggactccagctctttcaaagcatacaagctgcaatttttaaaaatgcttaccaaacagtctcaatatcttatttttgttactctggaaaatagccatttctctcctatccaaatcaaatttgagaagtagctcaataagctaaacatccattttttatggtataaaataatttaggaattttcccatagcccccctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcattcaaaagtcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggctgaacgatgtttctaagaactctcggtccactgtcctgttacgggacactgtcctgtccactgtcctgtcaggcctcctatggaaatggcagttcctgacgtcagaagatgtgggtctttctggtccatgccttagagccacatgctcactgccgggtctgtagacatcgatgtttaggagaataggctgaggtatttggtccaggctataatgtagaacttaagaactccataatttagaattttttaaaatgatttccgttgtaagtatagcccatcttgaaaatttagaacacgaggaacctaaaaaggtttcccattacttcatcaccaagacagaattccattaaaggtcagtgcctgtccttctaggctgctccttcatgttggtcttgtgtgttacatgactatgacctcatagttcttttcttctttttttttgttgagatgaagtctccctctgtcgcccaggctggagtgcagtggggcgatctcggctcactgcaagctccgcctcccaggttcacgccattctcctgcctcagcctcctgagtaactgggactacaggcactcaccaccacacccggctaattttttgtatttttagtagagacggggtttcaccatgttagccaggatggtctcgatctcctgacctcgtaatccaccctctttggcctcccaaagtgctgggattacaggcgtgagccaccgtacccggccaatggttcttttctatcgcacatgatttgttgtctgcaagcacctgcttgagggcattcctgtcaagaagaatctgtgctcagctttttgaagaatgcgtaatcctccactaactgaatgcacactgcagtccaaggtttacttaactgttcccatagagccattcccgttggactgttagtgagcattcatgattgaaagactagtttgtttctctcatatctgaaaatggaatgcattccttcctggcttttttttcttttgaatatctcaatttcactggtatcttgttaatcaaagttttgtggcattatcctcaaagatttatataaaccatattggagaagtaatcgatgattacctctactaatggacaataaagccactctcaccttgatttgttgaataacatataaattatagtgacagaattaatccaaaaaaaagaaaaacaggaaattgtttcctgggttctcgtctcatctggaaagatttacaagggaaccaaaaatcaatacaaaggaaaaacgaaaggttttatagataagcgtaccatcttcatcaaggcaagattttttctacattagggttcgggataaattctactcctcactgtcttctaaagcactggggccattactaggcacacatgcctcactgttcgaatatgatgaatgagccctggagatgtgcttagtgagagttgatggtaactgcaaagttacttgctggcttatccccctgagggctgagagctcctagattgcttttctgaaagatcacagagcaaaaataaattttaaaacccccacatttctagcaataaggaagctcaagggaattaaatgagtgagcacttgatgtaaagggagaaggcagattttctcaaaaacagtgaccccagttacatatgaatcccaaattcagatgctggagtcacttttgagactgcaatagaatatttgttaggtggatttgtggttacaagcacagaattcatggtttcctatttttcacagatgctttatcagaagatctgctgagcatcattgcaaacatgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagccacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccctgttatggccaacaccatctcagcaccctccttctcaactcctccctcagtccccactgcactcagagtgagttcagatccgcccaacagtggtgactgcccacctcctctggtccacaatggcaggagatggacaggagctttggccacacacagaggcatgtgattcagtctggggttcagaatggttttctgaagaaggtgatatgcgagtgagccaaatcttaaaggatgagtgggcatttctcaaatggtccacagggtagagaagagggctttgcaaaggccggaaagagcaagatgcgtttgggctgaaacgtgcagcctttggcacacagaggggcagagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagccatgacccagacctcaggtgcattctgatggctctccctacggaggtcgacccaggggccaccccccacccacccccaccctgccccacgtccctcctccacgtcagggggatgatgaattcagccatgtgcaacatcgtgggcatccttaaagcaaattgcagtggagggtgaattacagtgcttggggaatccctgagcaaagccagtaggcctcacacatgatctaaatcttgcttgatttgcaaacagaagagaaacttaactggagatttttttttttttttttgcaaatgcctggattaaagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttattttttctctgcaggcctgttagtgccaaagcccaccaagaccaagctcaaatttactcatgcccaattgtgataaaaatagcccaaacaagcagacttttagccacttggagcctacctctttgcatcttccacaaaacctctcccagcatctcaggccgttggtaagatacagcctcgtggtcatcagaccccaggtcgctgctgtctctggagttgcctgcccagagactccccctctccccctcaccatgttgctgagtaatgtcaccagacatggagaccctctgatgccccactgtgagttcctcgccatcctccccatctgggtggcggtccctcaccttagcctctggatggtcccctgccttgagggatgtcccctcttctgcacctgtgcccaagaaccaccccaaaggcatgtgtgtgtctctgcctccccgatcctaacttttgccttgctcagccctgagttcccagagcttccccacacccactaaattgctaagttcccccccagcggtctcctaagccgcttcggcgtccctctcagtcaccagcacctggttccccacccacaccttcccatccttgtctgggctggtgctgcatttccaatgtgctgcgtttccactgtgctgcgtttccaatgtgctacatttccactgtgctgcgtttccaatgtgctgcgtttccaccgtgctgcgtttccaccgtgctgcatttcctgcattccaaagcgacctttgggtgttggctgcaatgacatctttaagacaaatgttagttggaattaacttttgaaattctaaatgtcgaaatggtggattttaaaactcatccatttctactagttttcttgctttatggtgtgatgtctgcatgtcacaagtggatggcagggtttctaaggcttgtttttcctttgttggtattttcctaattgcctaggacgtatcacataaaattacttaacaagtagtggaaaagaatgatttttctttcaccatttcacctggacattttgtttgtatggtgtagtcggtgccgcaggagctaccttgttgaaagagaagggggcaggctgcttctcctttgtgtggtgtagctaatgccacacctgtacttcttgtttgtatgaagtggtcagtgccacaggagctaccactttagaagggaatggagcaggctgcttcttgtttatatggtgtagtcagtgccgcaggaggcactatgttggaagagaatgggcaggcttcttcctgtttgtatgatctagtcagtgccgcaggacgtactatgttgtaagtgaatggagcaggctcattcctgtttttatggtgtagtcattgccgcaggaggtactacgttggaagcaagtagggcagggtccttcttgtttccatggtgtagtcagtgccgcaggaggcactacgttggaagggaacagggcagggtccttcttgtttgtatgatctagtcattgccacaggaggcactatgttggaagggaatagggcagggtccttcttgtttccatggtgtagtcagtgccacaggaggcactatgttggaagggaacagggcagggtccttcttgtttgtatgatctagtcattgctgcaggagctaccagttgtaaatgaatggagcaggctccttcctgtttgcatggtgtagtgagtgccgcaggaggcagtacgttggaagggaatagggcagggtccttcttgtttgtgtggtgtagtcagtgccgcaggagctaccgtgttggaagggaatggggcagactccttcttgttggtacggtgtggccaatgctgcaggacgtaccatgttggaagagaatggggcttgagtttgttttgctttacactttgtcataaaggaaattatcagttctctgcataagcccctattttttaacaagggggtgtgtgtgcatgcacggcaagctggtccctttaaacattttagaatctctaaatataaagcttaagatattaggaatgctgttgataactgtgcatttggggtgaaggtgttttggtagtatcatttaaaggatttccagcttctttctgtttctgttaccaacctgtggagacctcttcatcatcctggactcagatcagggtcctcgactctgctgcgctcccagccagctgaggctgttgttcctcacctgtgtgtttttatagaagtctaggagctggggggtaggaggtgggtgtgggcaggggtcacgtcacttgcaggttgcctttgctagaagcagtcacattggctgagaacagaatccccagggcctgaggatgtcctgcagaaatttgggttttagtgtgtagcttggcatcagcctagagataagacaaattctattttaaaaatcaagtgctccatggcgggatggtgatatagttggctgtgtccccacccaaatctcatttgaattcccacatgttgtgggagggaccaggtgggaggtaattgaatcatgggggcaggtctttcttgtgatgttctcgtgatagtgaataagtctcacgagatttgacagctttataaggggaagttcccctgcacaagctctctttctgcctgccgccatccatgtaagacatgacctgctcctccttgccttccaccatgattgtgaggcctccacgtggaatcgtaagtccattaaacctccttttcttctcagactcaggtatgtctttatcagcagcatgaaaacagactaatacagatggagtaggggagggctactgaagaaatgaagcctctcagctactggaaatagatgcaatcagggtggaattactcacggacagtcctccagaggcagtggggtcattgtggagatctgtgtgccacaacagccagaaaacaaaggggccacgagccactgtttgctctgtggtctaaatcaatggactatcttaccacatgcaatgttagacagtgtattacatatgattattcataagcagaaatacaaatatatattatatactgtaagacagtattcattatatgataaatatgatgaattcacctagatacttcatatagaatttgccttcagttttagattgatacatgtgataagaacttctctgtgtgttcttgagaaagtgctcacattcccatgcataatggaaaggacattgtattttgaaatagaagacgaaattccagccaccactttgtcagttacaagctgcttagacttcatgtcttgcttagtttctcaaattctctgcacctggaaactggcaaagatagtgatgctcatttctagggttgtcatgaggctgaagtgagacaatgcagcagaaataatttgtgagcaataatgatacaaaggtcagtgattgattatgtaaataatggccacctttgaagcccctttcttcaaagagtctgagtcttgattcttgaagaggtgtgatttttctttgaaaaattgcattatttcttgctgggcactttggctcacgcctgtaaagacagcactttcggaggctgaggtcgggggatcgcttgagcccaggagctcaagaccagcctgggcaacaaagcaatacctcatctctaaaacaaacaaacaaaaaattgtgttatttcttgagttttgatctgatgaactactgcagtaaaccactgtgtctcacagtgttggaagggaatggagccagctccttcttgttgtatggtgtaggcaatgccgcaggaggtaccgtgtttgaagggaatggggcaggctccttcttgtttgtatgatccagtcattgctgcaggaggcaccgtgttggaagggagtggggcaggctccttcttgtttgtatgacccagtcattgctgcagaaggtaccatgttggaagggaatggggcaggctccttcttgtttgtatgatccagtcattgttgcaggaggcaccgtgttggaagggaatgggcaggctccttcttgtttgtatgatccagtcattgttgcaggaggcaacatgttggaagggaatggggccggggccttcttgtttgtatgatccagtcattgctgcaggaggcaccatgttggaagggaaagggcaggctccttcttgtttgtatgatccagtcattgctgcaggaggtaccatgttggaagggaacggggcaggctcgttcttgtttgtatgatccagtcactgctgcaggaggcaccttgttggaagggaatggagctggctccttcttgtttgtatgatccagtcattgctgcgggaggcaccatgttggaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccatgttggaagggaatggagctggctccttcttgtttgtatgatccagtcattgctgcgggaggcaccatgttagaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccgtgttggaagggaatggagctggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatggggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatgggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggggcaggctccttgtttgtatgatccagtcattgctgcaggaggtaccgtgttggaagggaatgggcaggctccttcttgtttgtatgatccagtcattgctgcaggaggtaccatgttggaagggaatggggtaggctccttcttgtttgtatgaaccactcattgctgcaggaggtaccatgttggaagggaatggggcaggctccttcctgtttgtatgatccagtcactgctgcaggaggcaccgtgttggaagggaatggggcaggctccttcctgtttgtatgatcccgtcattgctgcaggaggtaccatgttggatatggtaccatgttggataagtggcacagtggatagaatccatcgccatagtgaccatgagtggattcctgctattaaattggggtacgacttatgcagggcttgggggtgaatctggagggacaggtggccgagtcttccatgggcctgcacccccagatgagaagcccccaggtgcagatcgagaactgtacaccccagagggctgccttctggcccctcctaggttttgacatctacccagaggtgaccattgctttgatcttcatcaccatagttagttttccctgacctggcttttataggaaggaagttagatggtaacccctgggcctggcttctccacctccaggatttatttgctcctgccttgctgagggagacactcatcgttacagggcaggcatgggcgcctctctgctgagcactggtcaatgcttccaagtggctgctccaatctgcattcccaggagcaaagtgtaagagccccacagccctcaccaatccccgtcactgtgatccctttcattttggcccttcttgaggggagggtggcatttcctgtggtttaacttcacattttcctggtgactaattgtcttgagcacttttaaaatacattcattggccatttggagactctttttcgggatgtgccagttcaaacatttttcccattttttaatgaatcttttttgatttatagatgctcatattttctaaatatgtcttcagtgagaaatatgttttacaaatgtcttctcccagctgagattggccttttcactctccatgctgtcttttgaagaaacgttgttcatatttttaatgaagtcccctttatcaattacttatttcatggaaagaaaacttttttgttatgtttaagaatcttgctttctctgaagaatgtgaaggtatttttcttgtgttttctgctgaaaatgttattgttttacatgtcacatttagatctgtgacccatctcattttatgttttctgcaacatacgaggtggcaaccatgaggggtgtgtgtgtgtgtatgtgtgtgtgtgtattgtaaaccaaaaataaaattctaagtcttgcgatcatctgaattgacccctcctgttggcaagggtgttccaaagctaacctgaaaaactaatctgaccgtgatggggagagtgaggtcagacgtgcctcatgacaccctcctcccttttggaatttctgctagaacagacttcttaactctgagaagaaacatttacagtctcttctctcagaagcctgctgcctggagacttcacctgcacgatgaaaccttggtctccacaacctgtgtcttaacccagacagtcttaagtccttagacgataactttactctttcaaaaaattgccactcagaaaatttttgaatctacctttggcctagaagcccccgcttccagatgtcctgcctttttgtactgaaccagtgtacatcttacatgtatttgattgatgtcttgtgtctccctaaaatatatgaaactaagctgtgcctcaaccaccttggacacaagttctcaggatctcctgagggctgaatcattggccattggtcactcatatctggctcagaataaatctcttcaactattttacagagcttgactcttcactgacaatatctataagtgtttgtgtatatatagaggcatgtatatataggtagatttgtatgtgtgtgtgtatatatctataataaacacaggtctatatagaggggtgtgtgtgtatgtatgtatagatatgtgtgtgtgaaagcatgtgtatatgatatttattcagaaccatcctttacccagtgaactgcacccatgcctatatcatgaatcgagtagccacatgtgtgtgggcgaggactgctagactcttaccattatgtatacaattatgagagagagggagagaacctgagttaaacaattagccacatttctctttaagcctactgagaaaaagacacagggacccagcagacatcagaacaccttgttggggcagctcgcactggggcgcaggtggcagaagcctcacgggattctgtacagcaggaagagaggccggcttcagcccctcctgcctgacagcacaggggtcttgcctggcctgggaggagccgggattggaggcaggggctgctcctgcctccagaggtttccaggagactgcatgttgtgccctgccggcatccacacatttgtgtagtacccactcccagacaaggacactcatagacttcctccggcctcgcgtgggagccgagcctgtggtctgcatctcgctgtgctccacgcagctcctgcatgcagctcctgcacgcatcggctgggctcgcagatgtcaggtccgcctcctttcctcttccctgagcctctgccgagccctcccgacccgagggtcggctgctcccttccccgcctgagtcacttccgtgactctcttcatcctcagagccatccccttcctcatctgtaatgtgggaagaacacccacctcgcagggttgtttctggttgaaaggcagcacttgtcaggctccttgcacgctgtccacagccggccatcgtaagagttacggcgactgtcacctctcagccactcctcggcatcggacctcttggctcctggccatggcattgaccacagaatgtcataaacagcccagtgtgtttttccacgagagcagtggtcggaggctcctgcaggtaaatggctggagattgattgacgtgggaatatcacggcatcacagaatcagagcacatttgttcacggtgcaggaataacatcaagtgagtggtgagctctaaaggacctggccctcgaggtagctcacaccctcgatgatgaatggagccaggccacaggtgaaatttccatccaggcgggacagactcaagccgggactgggttcccctgacgcccggcttcccaaatgtgcttccctcccggatgcacagagaacgaacgtggcatggacattgtgagctgcaggaagcgatcccaccagggatcaaaaagccaacttcctccagcggccattctgcactaagcctctttcgtggagttcacgttctgtccaatacagccttaaagcccatgaacaattctgggggagacgatcaggtctgaaaggaaaattccatatgggtatttaagttattggaagaacccttaagatctacctgggtttaacatagaatttgctatatgtaacttggtatatcattctctatagtcatttgcctaaaaatcatcaaaagtataaattcaatgttgcatctcccatccagatattttgtgttaaaaacacctcatatctgatgtctgacagctattttctttttttctatgtatttgccttgaattcacattcgtagtcaccttttttccctctcactttgtttttcatttgcattttgacctaattcatgaaattatccagcagggagagacctgatggagttttgctggaatgaagctccttgacacaatcgtctcctttttagaagtgcctgtagattgaaagttcaattgctcaaaacagtttgctaaagaacaaatgtgtgtctattaagagtttaagttgcacttgtaaatccaccaatggcactaagatatcatttagcaatattgacacttgaagtgataaaaaaacagaaaatacctttgacgtcaaataaatgtattagtctttaagaaaaaaagaggtggaattgaccttggtgtcttatgaaatcgcagaacatatgatgggtataaacaatgccagaataaacaagattttcaaagtttttggaaaaagctgagctcatgccgattatagaaagcatttgcatcttttgaagggttttcctctgagggttcaaatgtccctcagggatcatgctggtgataatcccagctcacaaactgactggtcttaattgccttcaatcaagtagctccagcaggagacgggaaaaatcaccgctgagtttcctcatacttctggccacctgacagggtgtcaggcgtttttggggacaaaatgaatcctcgcacacctggcccagcaggatgagggcatcccgtgtcccgctgctgccccgctgagaaagaggtgccgttacaggagtggaaagctgacttcgtccacagtttctctcccagcatttcacactgcattgctgtttgcttcttttcatgggcggcacacatctctggcactcagcgtgtccatgtgctgttactggatggccatacctggcaaacatattgacctgtgtcttgcggcctcagtccacagctttatgctcaagcgctcttcaagatggaagtttagaatttcttctttttggaattcagaaatcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatcctctacagatatgtatgctcatgttatatatttgatacattcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagatttagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatgtaatgagctatcattaaaatgatttttattcatgtatcagcaatcaattcaataacattgtcctccaaatttctaaacaaaatattggaaaatacctcatttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaatacatttttgtcagaatatattttgaccaatagaacaaaactgcagaccagcctacttatgggaaacttcaccatctagcctattggctgaagccattgtcatcgccaaatcaaacagccaaatacaactgactctctctctctctcaggagagacttaactttatttttaacttactttattttaattcaaattcatttattaatggttcctttgacaacccgctcacttctgaaatcagaaaaccagcaacttcctcagttcccacaagttcgcctggacaatcacacgggcaggaacaggcgcgacaccctggtggcttcatggtgctttgattaaaggatgttttatgccacaggatttcaaatgatctctttgtttggagtaccagaagtttctgtcctccagagaactgcccctggtacattctagaagggtgggagaccctccttcggaaaacaggggagtgggaaggaaccctgcaggcagccacctccagacagcatgtgctgagctcgggagagggtgcctgtgggaaccaagcctctggaatgagctcccttgaagccagtcatgacctgggcctccaggaggcctttcgggtcttctggggagctgtgccccttgggcctccggagagaccccacttattctccctgagaatggtgtcttatatctggaactcactgcttctgtgttcttctcccccatctcaaacacatccttgcatttgtctccacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagccttttactgggttcttgctcgtgctgggtgctgcgtgcaatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgctttccttcttggcctcagttggacaatccctaaaatgggataagactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgctccaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactcgcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactccagggcacagatctcctaggggcacctggagctctgtgaacaagaaccacaccaggaagtgcatgatcccaaagggtcatctttctgctaccacagggtcctcctatgtcctgaccaatggtctcttcctacccaggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaagtaagttttagaaaacgtttctatgtttgttatgaaactaagtgctatttaaaacgtcaaacagaatggtataaaacaaaatgtgaaagtctgtttctttgtcctattcccaggggtagcagttgtgaatatctggtgcatctcactggaaattccctgggtacacgtatatatagcatgtatgatagtgtgggtacacatatatatagcatgtatgatactgtgggtacacatatatatagcatgtatgatagtgtgtgggcagatgtgtacatagcatgtatgatactgtgggtacatatatatatagcatgcatgatagtgtgtgggcagatgtgtacatagcatgtatgatactgtgggtacacatatatatagcatgtatgatagtgtgtgggcagatgtgtacatagcatgtatgatactctgggtacacatatatgtagcatgtatgatagtgtgtgggcagatgtgtacatagcatgtatgatactgtgggtacacatatatatatagcatgtatgatagtgtgtgggcacatgtgtacatagcatgtatgatactgtgggtacacatatatgtagcatgtatgatagtgtgtgggcagatgtgtacatagcatgtatgatactgtgggtacacatatatgtagcatgcatgatagtgtgtgggcagatgtgtacacagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgtatgatagtgtgtgggcagatgtgtacatagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgcatgatagtgtgtgggcagatgtgtacatagcatgtatgatactgtgggtacacatatatatagcatgtatgatcgcgtgtgggcagatgtgtacatagcatgtatgatactgtgggtacacatatatagcatgtatgatcgtgtgtgggcagatgtgtacatagcatgtatgatactgtgggtacacatatatagcatgtatgatcgtgtgtgggcagatgtgtacatagcatgtatgatactgtgggtacacatatatgtagcatgtatgatagtgtgtgggcagatgtgtacatagcatgtatgatactgtgggcacatgcatatatagcatatatgatagtgtgtgggcagatgtgtacatagcatgtatgatactgtgtggtcacaagtatatagcatataggattatgtgtgggcacatgtattggcacatcacaggtgggctcgtgtgtatatagcatgtatgatattgtgtggtcgtgtatatagcatataggattatgtgtgggcatgtgtattagcatatatgatctcgggtgggcacgtgtgtatatggcatataagatagtgtgtgggcacgtgtgtatatggcacataagatagtgtgtgggcacgtgtgtatatggcatataagatagtgtgtgggcacgtgtgtatatggcatataagatagtgtgtgggcacgtgtgtatatggcatataagacagtgtgtgggaacgtgtttatatggcatatgagattgtgggcacgtgcgtttatggcacataagatagtgtgcaggcacgtgtgtatatggtatataagatagcgtgtggacacgtgtgtatataggatataatatagtgtgtgggcacatatgtatatggcatataagatactgtgtgggcacatgtgtatataggatataagatagtgtgtgggcacgtgtgtatatagcatataagacagtgtgtggacacatgtgtatatagtatataagataatatgcggacatgtgtgtatatagtatataagacagtttgtgggcacatgtgtatatggcatataagacagtttgtggacatgtgtgtatatggcatataagatagtgtgtggacatgtgtgtatatggcatataacatgctgtgtgggcacatgtgtttatagcatataagacagtttgtgggcacatgtgtatatggcatataagacagtttgtggacatgtgtgtatatggcatataagatagtgtgtggacatgtgtgtatatggcatataagatactgtgtgggcacgtgtgtttatagcatattagtttgtgggcacgtgtgtaaatagagcctattatcccatgtgtacctgcactttttctcatcctctgtgtcacatcatgtgcatgctcagtgcctggtaaggaccacttagcaatagttcttatacatgtctgcttaacattaagtgaacagaaatgtaattgtttacaacttagtattccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgttcactcttaccagaaaagaaagagacaatataggtagatttttaattttatttctctctggaaaccagccttgaagttaacaagggacattttctttttttttttttaagacagggtctcacccagtcgcccaggctggagtgcagtggtgcaatctcggctcactgcaacctccgcctcccgggttcaagcaatacttctgcctcagcctccctagtagctgggactacaggcaggtgccaccacacccggctaatttttgtatttttagtagagacggggtgtcaccatgttggccaggctggtctcgaactcctgaccttgggatccgcctgccttggcctctcaaagtgctgggattacaggtgtgagccaccgtgctcagccaacaagggacattttctacttaagagcacagatggtttcgatctcatgtcctctctaacattcattcaataaaacttcactggcagttattctgtgccatgctgtgctgtgtgctaggcaggctgaaaaggaagacaggctggtccctggaaggtgggcaggacagttacataaaccagcagttacaaaattctgggcatctgcagaggaggtcccagtgggcaaaatcaagacatctaaacaaaatatcccaaaaggaataatattgggggaaaggtggaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccggatataagcgattctcctgcctcagcatcctgagtagctgggactacaggcatgcgccaccatgcctggctaatttttctatttttaatagagatggggtttcatcgtgttggccaggctggtctcaaactcctgaactcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaatgaacagtctgccaagcagaggccctcgttcccagctaagtggctccccagcagaatctgtgcaaaaaaatgactgagttatgcagcctggagaagcagtggagatgggcacctattatctatcaggtcttgggttccaggcttgccttgtaacttattatctgcgtgtatataggtttgttgtccataaaaagagtatatttcccaggctggccttgtaacttattagctgcatgtatataggtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggagggagcacgttgggtagggagctgcactgagagaactactctgtgtggaggttgggctcccctggagctgcactgagagaaccactgtgtagtggggtgggggctccacctttgggctcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttgggggccaccatctgggtgggaaggacacgggtagccctgaggccagacaaggaccccaggaaaagcccagcccttcagggccacacacaccgtgggggaggttggggggcctctggccagggcatcatcctgggcacgttctgctggtatccagggtcacgtgatggttgtggtgagccccacacacccgcccccagaggctccttcctccacccacaatactcagttatgtggatggctgcgttcgtataaagataaatatattaatgtgggttcaaacgttctttggcctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgcgggcagcaggcggggaggggctggaccatctcaggcggggagcctgcagggcttgttcccaggagctgaggagctgactccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgtaggtaaacacacacacacacacacacacacagatatcaatgaaagataaatgaacagcaagatgctgtttttaaacatacagactggaaagaaattatgaaattttaatttagtgttgttgagggtattgagaaatcatttgcatccatgcattgctgtgcaaaagtaaactggtgaatacattcgggacacgatgtgacataaggtatgaaatgaaatcaggcccattcacagcaccacaagaatcttccctagggacaatgtccaaactgcccttaaaagtgggtgaatatattagtttgtcacgattgtttatatcaccaaaatactgaaaaactttaaacgttgatcacaggctatgagcatgagaaacacaagcaactttagacaatcatgttatacagtgatattatggaaatggtaaaatgttgcccagcttagtaaaattttagatgatattgtacttgtcacttttcttatttcaaaatgttcattattgagcatatattatctttgtacttagagaaaaataacaataaaattatttgtaaacaattttaaaaataaaaggcaagaccacatctggcagggaggacacctgcgtgcccgtgggtgagaacgtgggagaggccccagggtgggtctccagggcactttccagggctcttggtgtcaggcatgaacctcctggcttgcagttaagagtgtccatcaattattcagatcctgtccatccccagggcagccttcagtagttgagtgattgagctaacagtcactccagtgagatgaaaaatataccgtatactctaggagtagctccataaacccaatagatgacacatcataaatcagtgcttttaaatgtttgatgtcctttacactcaaagcatccagtttggtctctgagtatttacggtggagtgagagggtggaagttcttagtgagcttggagcaagttgggacttttgaatcccaaagcaaaacagaaaatgatccacacaatttatcatatctatgtttattcagttttcctaagagaaacatgtttccagcaactacacgagactataaattaaagtgttttgagtctctgactactgatcactcagcccagggagctgtgagagctttgcagcatcctctattttaggactgggcttttcttcatgaccttgctccttctggtctcggctaagtgggggtgcaggcagcccgatgatgttccactgggtgctgcaaaccccccatccactgcagaaaatatgtagctatgaatgtatcgacaacctcaaagctatgcaagcctcctcatgcacaccaatgtgtatctctaggtacatattacaaagtggagttagtgggttatgaattatgttcatgttggaattttttatttccataagttattgagaacaggtggtgtttggttacatgagtaagttctttagtggtgatttgtgagatttcggtgcacccatcacccaagcagtatacactgaacacaatttgtagctttttatctctcactcccttcccaccctttccccctgagtccccaaagtccactgtgtcattcttacgcctttacatccccatagctgaggtgtcacttatgagtgagaacataaaatgtttggttttcaattcttgagttacttcacttagaataatagtctccaatctcaaccaggtctctgcaaatgccattaattcactcctttttatggctgagtagtattccatcgtatataaaaaatcacagtttctttatccactcattgattgatgggcatttgggttgcttccacagtttggcaattgtgaattgtgcggctataaacacggatgtgccaatgcatttttcgtataatgacttcttttcctctgggtagatacccaggaatgggatcgctggatcaaatagtagttctacttttagttctttaaggaatctccacggtgtttttccacagtggttgtactaatttacattcctaccagcagggtagaagtgttgttcccttttcaccatatccacaccaacatctattattcgttgattttttttattatggccattcttgccagagtaaggtgctaatgtgttgtgttttgatttgcatttccctgatcattagtgatgagcattttttcatatgtttgttggccatgtgtgtatcttcttttgagaattctctattcatgtccttagcccactttttgatgggattgtttggtttttcttactgatttgtttgagtttgttgtagattctggatattaatcctttgtcagatgtgtggattgtgaagattttctcccactctgtgagttgtctgtttactctactgactgttccttttgctgtgcaaaagctctttagtttaattaagtcccaactatttatctttctttttattgaatttgcttttgtgttcttggtcattaaatccttgcctgagccaatagcaagaagaatttttccaatgttatcttctagagtttttatggtttcaggtcttagacttaagtccttgatccatcttgagttgtttttgtataaggtgagagatgaggatctagtttcattctcctacacatggcttgccaattatcgcagcatcatttgttgaatagggtgtcctttgcccactttatgtttttgtttgcattgtcgaagatcaattggctgtaagtatttgggtttatttctgggttctctattctattccattggtctatgtgcttatttttgtaccagtactatgctgttttggtgactatggccttatagtatagtttgaaatcaggtaatgtgatgcctccagatttgttctttctgcttagtcttgctttggctatgcaggctcttttttggttccatacgaattttaggattttgttttctaatttgatgaagaatgatggtggtattttgatgggaattgtgttgaatttgtagattgctttcagcagtatggttgttttcacaatattgactctacccatccatgtgcatgggttgtgtcccatttgtttgtgttgtctgtggtttttttcagcagtgttttgtagttttccttgtagaggtctttcatctccttggttaggtatatttctaagtattttatttttttcagctattgtagaaggggttgagttcttgatttgattctcagcttggttgctgttggcgtatagaagagctactgatttctgtacattaattttgtatccagaaatttttctgaattatttgatcagttctaggagctttctggaggagtctttagggttttctaggtaaacaatcatatcattagcaaacagcaacagtttgacttcctcttcgccgatttggatgccctttatttcttttgtctgattcctctggctaggatttcgagtactatgttgaagaggagtggtgagagtaggcatccttgtcttgttcccattctcagagggaatgctttcaacttttccccattcagaattatgttggctgtgggtttgtcatagatggcttttaatacattgagctatttcccttgtatgccaattttgctgagttttgatcataaaaggatgctggatctttttgaatgctttttatgcatctatcgagacgatcatgtgatttctgcttttgattctgcttacatggtgtatcacatttattgacttgtgtatgttaagccatccctgcatccctggtatgaaacccacctgatcatggtggattatctttttgatatgcattggatttggttagctagtattttgttaaggattttagcatctatgttcatcagggttattggtccgtagttttcttttttggttatgtcctcttctggttttactattagggtgatactggccttacagaatgatttaggaagggttgcctgtttctctatcttgtggagtagtgtcaataggattggtaacaattcttctttgaatgtctggcagaattcttctgtgaatctgtctggttcttgactttttttgttggtaatttttatattaccatttcaatcttactgcttgttattgttcagggtgtctaattcttcctgacttaagctaggagggttatatctttccaggaatttatccatctctaggtttcccagttgatgtgcataaagctgttcatagtagccatgaatgatcttttgtatttcagtggtgtcagttgtaatatctcccattttgcttctaattgagcttatttggattttctcttcttttcttggttaaccttgctaatggtctatcaattttatttatcttttcaaagaaccaggtttttgtttcatttatcttttgtattttttttgttgttgtttcaatttcatttagttctgctctgatcttggttatttcctttcttctgctgggtttgggtttggtttgttcttgtttctctaattccttaaggtgtaaccttagattgtcagtttgtgctctttcagattttttatgtaggcatttagggctatgaactttcctcttagcaccgcctttgctgtatcctagaggtttcgataggttgtgtcattattgtcattcagttcaaagaatttttttttttttgagatggagtttcgctcttgttgcccaggctggagtgtagtggcacaatctcggctgattgcaacctctgcctcctgggttcaagtgattctcctccctcaggatcccgagtagctgggattataggcatccaccaccatgcccagctaatcttttgtatttttagtagagattgggtttcaccatgttggccagactggtcttgaattcctggtctcaggtgatccaccagctcagcctcccaaagcgctgggattacaggcatgagccactgtgcctggccccgaagaattttttaatttccatcttgatttcatttttaacccagtgtcattcaggagcagattatttaatttccatgtatttgcatgattttgaaggttccttttggagttgatttccagttttatttcactgtggtctgagagagtgcttgatataatttcaattttcttaaatttattgaggcttattttgagacctatcatatggtctatctcagagaaagctccatgtgctgttgaatagaatgtgtattctgcagttgttgggtagaatgttctgtaaatacctgttaagtccatttgttccagggtatagtttaaatccacagtttctttgttgactttctgtcttgatgacctgtctagtgctgtcagtggagtgttgcagtcccccactattactgtgttgctgtctatctcatttctcagttctgttagtaattgttttataaatttgggaactccagtgttaggtgcacatttatttaggattgtgatattttcctgttggacaaggccttttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatgcattctgcaattctgtatcttttaggtggagcatttagaccatttacattcaatgttagtactgagatgtgaggtatcattccattcattgtgctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtctgggaaagattgttatctttccttcatttatgaagcttagctttgctggataccacatttttggtggataattgttttgtctgaggaggctgaagatgggtcccaatcccttctagcttgtagggtttctgctgagaaatctgctgttaatctgataggtttttactttataggttacctggtgtttttgtttcacagctcttaagattcttttcatcatcttaactttaggtaacctgatgacaatgtgcctgggcaatgatcttttagcaatgaattctccaggtgttctttgagcctcttgtatttggtgtctaggtctccagcaaggccagggaggttttcctcgattattccccaaaataaactttccaaacttttagatttctcttcttcctcaggaatgctaattattcctaggtttggtcattagacataatcccagacatcttggaggctatcttcatattttcttattcttttttctttgtctttgttggattgggttaatctgaagaccttgtctttgagctctgaagttttcttttgcttgtttgattctattgctgagactttccagtacattttgaatttctctgagtgtgtccaatgtttcctgaagttttgattgttttttatttgtgatatctatttccttgaatatttctcccttcacttcttgtatcatttttctgatttccttacattgggctttgcctttctctggtgccttcctgattagcttaataattaaccttctgaattctttttcaggtaaatcagggatttctccttggtttggatccattgccagtgagctagtgtgattttagggggtgttaaagagccttattttgttatattaccagagttggttttctggttccttctcatttgggtagtctctgtcagagggaaggtctagggctctagcctgttgttcagattctttcgccccagggggtgttccctggacgtgattagtactctccctgtttcctagggatgtggcttcctgagagctaaggtgtagttattgttatctctcttctggatctagccaccaagttcaaattgttacaaagttcagctggcagtttccttctccctgtggccttttacaggtgcctctggcagccctcctgaaggacccctgtgaggcaaggtggaaatggcttcctaggggacccagagatcccacagggcttttctggctgcttcctctactcttgtattccactcggctctctaaatggactcagctccgggtaaagtcagaatcttctcccgtaatctagaccttcaggttccgcagtgggggtgcatgttcagggtggacgatctctcccacttcctcagtttgggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatgattgcttggcttttcattttgtttacggtgccattattcataaatttaggtcgattttcgtcaattttttttcttctctatgacatctacattgttatcttactgagcaggtcttccttatctggtatatataataatatatatataaatatatttttctatattttattttaaacatattaaaaactgggcttgatatacaactttgttttattctgactctattttgtgtagataaaatactgctttagtgagtaacatttaaaaaagccatggtgagagcagcatctgcctctgttcctagataaagggcatgattctgatgtttttcctcacatactgtgtctactaggaatttctgctagacaacttcagttagaaatttgaaaatcttatttgtaatttcccaagaattttaatgaggcttgtgggttccagctttactcaataccttcccagcatcggcagaggaggccacagggcttccacttcacttcattattgtgtgagctacactggtagatttccaacgcagtgccatatttacatggcctgcatgatggtgatgcaggttttcatttattcttggattgaatttgctaatattttatttgaaatgttgcctctctcttcataagcagagttgtgctacagtgctcttttccgatgctgcacctatttgggtgttacaaacacaccagcatctgacagtggtcaggggttgcccattcttttactatgctcaggattaccttgtctaaaatcaaatttgggctttttgttttgaataactggtagagcttatttgtgactctggtcctgataacctctggggtggcagatctttggttatgggctcagttctgggtgcagttagtctattcgagcccataagtctttcctgttctttattttctattaccttcctattacactttttcatctacttcacatttctcaccctcttatgctgaaagcgagttgagttacgttcactgtgtcgtgctttttgacaagtgtagttaagactatgtattttcctgtgacccccccccacaaattttgatacatggtccttacattgatgttaattcaaaataggttttaattcaaataagaatttcttacattaaacttgagcacccacatgtaagtgtaatttcacataaatgtaaaacttaaactgtgcctgactctcccgacacgagtctcttcctctccctccctcatttgctagactctcctcctgctcactcccatgttctccactcatgcccctgcccccaaaccaatcatttgactcccaaatgttgatatttgaagtgtgtgtaggggaaagggggcatgataaatgaaactagaatagtaagaagctggtgtagacagcatagtgggctcaaagggattcactgggcaccccgttttaatcagcatgcccttgctatgatctcagcactcatggcatgcccttcccatgatcctgatgttcatggtgtgcccttcccatgatcctgatgctcatggtgtgcccttcccatgatctgaaagttcatagcacatgcccttcccatgatctgaatgttcatagcacatgcccttcccatgatctgaatgttcatagcatacccatcccattctttgagtgctcatagtatgttcttcctgtgatctgagtgctgatatcatgcccttcccatgatgcaaatgctcacagcatgcacttcctgtgatctgaacgctcatagagtgctcttcctgtgatccaaatgctcatggcatgccctttccatgacgtgaatgctcatggcgtgcccctcctgtgttctgaatgcttatagagtgcccttcacatgatctgagtgctcatggtgtgtcctttctgtgatccaaatactcatgctatgtccttcccttgatccaaatgctcatggtgtgtccttctgatgatctgagtgctcatagtgtgctcttcccacgatatgagtggtcacggtgtgccctttccatgatatgaatgctcacttggctacacctaaagaagtcatgcacaagcatattctcttgaatgttgttaacaaaaacaagactatgctgagtacacgttctgtatcttggattctcactcagtagtgatgtgtcctgggaatccccccagtggagcgccaagccatccctgcttacggctggactgttccacactccgggtcacagccatgggtgtgcccttccgtgttacagcctctgccacagcgtggatcaccagaagtgacactgccaggttggaaggcagctttagcactgctatgctggtactactgtctaaaaattctgtgaccctcacagcaacgactgagtgtaccccttactcacattcgccatccacactggcaacagccttgtttttttctcatttttttctgcttgtttggcggcaaaaaaaaaaaaaaaaaaaaaaaaggagagagagagatatttcgttgttacattagttgctttccctgaatattagtgaattttaaagttgtcctttatttatctttttttggcaatttgtatttgttcaacgaatgatctgttcatagcctttgtccatttttctactatttgactgttaattgattttaattgctcctttccactctagatgttaactctctatctctcacttttcttacaaatgtttttctacagccccatcaatacagaactgtcagcatgaagcactttcatattttataaggccaggtctacttatgtgttgatggcttctaggctcagttttggttcaggaatctcctttgctcgaagtcgacagtgacctcctgggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccgcatcaccattcttttccctagtttattaaggaataaataaataatggaatttgtatcttcatataaactttaaaattaatttatctatttcaaaatgaaaaagtactatcattattattgtaaatgaaattgcatttaatttatacattcatttagagagaaatgatcttttcccaaattttttgtatatttaatgatgttttatgattttctttttgtagatcatgtgattattttgttaaatttacacacctgattttgatcaacttttttgtcattatgaaagggatttttttttctccattaccattcatggtactttgctaaagaacaaaacaaaaaagaaagaaggaaaagaacagttttatacttatcctcagatcgaagacattttttaaagaaatgttatcaattttttagaatttttagatgttgtagacatctaacatagcattaagaaaaaataattttattatgttttaaatcttattttctcttacagtagctttaccagctcttattttattttctagactttggtctaactgagatagtactaagtaccaacaatgatagcgggagtttctgctagtccttaattttaaattaaattgttccattgtttcactgctcgagataatatttgttattgtttctacattatattttagcaattccaatctattctatttctatttaaccaggaatggtaagtaatagtaaattgtgttattgcattttaagtacctatgatattaatttttcttctttaatttgctgacaccctggaaaatacaactctattctccaacacggaaccattctgtgaatagattctatttgactatggtaattgctgttttgatttgctgccctatcttttattattttatttagaagggatattgatctgtatgccctgtccttgtcctgttttcatcagaggccaatacaaaagtttcgctgactctgtagagtgcactggggcccttttcatcttttccatggctgaaatagtttaagcaaccttggagttacctatcctttcgagatttgatagaagtccaccgtcaatgccatctgacctctggatttctgatcaccttgtctatctcttccatcctcattgtccattggagttttacatttcttcttggaaaagctgtggttatttctattttgttagggagtcatcgatctgttcttcattttccaatgtgctgccatgaaaccgcatatacagtcgctcctggttcttctcatctctcctgcatgcctgagccctgctcctttctcatggcaaatcctgcctcactcggtgctctttctttgttttccacactgggttgtgaagcagggcttcatgttttcttcccaccaggtcttttattcatagttaattattttaacttctgcatgcattaatttaactttctcatttatttgtgctttagctctttgttacttaactaaattcttaaaatagctacttaatttcttggtttttgttgttttgatgaaagcaatttaaagagcacagattttcttctgaggaaggctttgctggtgtgcttgaattttcttaacaagtgagttaacttttcattgatttctggagacactttcagctcttcttaagagtctctttgaatcagtgagtaggagaatttgcagctccttgttatttatttgtaattttattattatttgtgctcttcaatttaattcctctatttcctcccattcttggggcctctgggcctgtatattctgaagggcgtgcactgaagttccggctgtcacggttttcttggctttcctactcttttgctgaatttcagctcctccctgggttccctgctggccccaagtactcacctcgtctactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttcctactcctcagtgcccaggctgcactttgccccgagaggagctttccccttattttcactggtaataataatgtcctattacgagaagaccgtgatcttcaggaagagtctctttcggaatctgtccaaccccggtgatcttgtgattctggatgagcgatttaacctcctaaatctgataacgcccagggtaggccctgaccccgtgacacctcaccagggaggaagagctgacagggaaagggcacatgctctctgcagcccacagagctcgactcttcccaggaaacctgtaaatctggaaaaaatattttagatctccatgttacagatgagaagatggaagctggccacagccagagttggaatcccacccaaggtctcctcactcccctcaagctgcctttacactaaacagtgatgcccacaaaactcggagactgtttactcattgtgctcctaaaccaagtccatggcactggaaaggaagaagtcagctcttccgaaagtcagaaaataaaccagaccggggattccatgagcagctagagcaggtctgagcaggagcgagactggctcaggccaagagcgtctgagctttggggagatgtggactcctaggatgtggggtccatcctctgggttcaacctcttccaggcaagagaccaccagtgagcaggctgaggggaggtgcggggctggctggaccgacccctgcagcctcttccaggcaagagaccaccggtgagcaggccaggggggaggtggggggctggctggaccaacccctgcagcctcttccaggcaagagaccaccggtaagcaggccggggggggaggtgaggggactggctggactgacccctacagaggactggaggggcagagaaacgtgcggcgctgcggggtcgtcgccggcctcgaacttccagagtcttacaaagggtgcacgggggccctgggtgaccttgaactcccctttgcctgcagctcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattcccagaacaacccttggaggtgggtggaccaggggtgctggtgtttttgtatttcagagacagtgcagtgaatgaagaaccgactctgtgtgaggattctgaactaacaagttagagtctatttgaaacctttcttcattttatgactttcttaagtatcacatgagagggtcttgaatggagagtcaagttggccttttattaattgtgtgatggagaaaagcacttatgcacctggaaatgcggtccctgactctaggggtctcacaggttgttaggaagaaggatgggctgtttgatatgcgagtcaccgtgtgtgtctgttgcaccaggccctgtggcggcctgggcatcgtgtctgcagtcctagccgggagcctgcagggaggtgcgcgtcagtcctgttctaaaggaggcactggagccttgtccgaggaggcacaggggctgtgtgtggcaccggctgcccccgggcaccatgcgcccctgccgctttctggccttcactgcactggggtccaggccccaaaggtcagagcagagggtctgggaagcctccatgcgctgggtgttaacccttagttcctgggtggcgaggggacctggagcttcctggaacaggggctggcagcagcaggccctcacacttctccggcaagcacggcagacgggctcactgtcctaacacgcatccacacagcaaacacagcagacgagctcactgtcctaacgcacatccacacagcaaacacggcagacgagttcactgtcctaacgcacacatccacacaggaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaaccttctttgagtgagaacctcatccagcccagggagctgtgagaagagcagctgcctctgatccctggagcccgttcacagagcgggaaacgcccaattgtcacgcaccctgttgtctttcttctccatggagttctgggattatttagaggcgtgaattattaccaggcccagtcattgtagattagagacagtttaattccaagttactgagaatcctactgacctagaaataatgacatttggttgctgcggctgtggctgctgctgctcctccttgtcctcctcctcgtcctcctcctcctcttcttcttctccttcttcttctttttttttgagacagtctcactctgtcacccaggctggagtatagtggtgagaccttggctcactgcaaccaccacctcccaggttcaagcgattctcctgcctcagcctctcaagtagctgagaccacagacatgtgccaccactcccagctgatttttatatttttaatagacatggggttttgccatgttggctaggatggtcttgaactcctttcctcaagtgatccgcctgcctcaggctcccaaagtgctgggattacaggcctgagccactgcgcccagctgccttttcttattattaatgaaataataacaacagcaaccaataggaaaagtgttcttctctgtttcatatttaccttcctcaattcattttctgtgtgttctgctttttaaaaaactgtgaacattcttttcttcttggttttacatttcacttttgaatttccttttgtatttttttcagttaataggtcctctttggtgctttttgcaaaaacctttgatacattaaaataataagttgtgtttaacgtgtcgatagagccactgctgcgacttctagccgtatttgaaagatccacggtggcctgggcctggaagcctcatttttctctccctggttctaccgactcgtagtttggtaactttgtaatctgaatctctcttcttctgaaaaacattagataatgaaaagagatgccagggcaaccttatgaaagagaaatagcatccccccctctatcacccctcaaaccccctacacacacacacacacacacacacacacacacacacacacacacacgagccagccagggccaggctaatgcacacatcagcaagagacaggaaaggtcatctcagagccgggagtcacagctttctcctccatctgtccacaccacctccctcctccttcatccgtccaaaccatgtttctcctgctgcatccgtccacaccacctccctcctcctgcatccgtccacaccaccttcctcctgctgcatccgtccacaccacgtccctgctgctgcgtctgtcctcaccatacccactctaatttgtcagggcccaaccacagccgcccccactctgaggatcttggctcctctaatttcttttgtcgaaagctgagagctatcccctccctcagccctgggccacaggacttctgctgtgggcatgtttgggagggatctgcagggccgccctctgtgctggttcctgggatccggcatctctcgggggactcgcacgtaggaagggctgataaagttgctcttgctggcttgagatcccacaggaccctggatccataagccctgcttcccaccaggaggaactgaagctcttgctcttcaatcccagaaaaccctagctgctttaggtgtgtcataagacaagaactcacaatcagttgctcactttggtgataacttttgtgttctacagacaagaaaagaatgagaaaggaaacccttcccagcacaggtgtgagggaggcagagaggaggtagccatcctcggggagtctgggtgtgccatccaggcagcatggagtttgggttccacagggtgaaaagataaagacatcccaaatatctggcgtggatgttttctatgccccggccatcagatagcagacctatttctggagcacagccttgatttccccagatatccagggacccacagaagctttgctttggatgtgtgtggaggtagaaccagaccccggagggactgcagatctccctggacatccccatcccgggcaggcagatccatgtctcggggcaggggctgcatccctgggccactcggctgctgacctttgctgtagctgagtactttttcagattggttgctcttccagagcaaaggagcagatggataaagtcatgcttccaaggctggaaagaaagagaaagggccgttcctgcagtgggtgctgttgctgccccacccaggcccctttatctgcagggccccatcccccagtggcctccaatgttggctgacaaagtctcctggtcgttcctctccaggggtagctgtggaggctgttccctgccctgcagggacagccaggcccctacctcaaggctggaccaagcccaggtgcgccatgctgcagggcttcctgcggaggagcacaagccaggcctggctgtgtcacgtccttggggagctgggtgcctgctcagcctcctccctggagcaccctcagcaagcatatgggagcctcttattggactaatagggcatgtttgagaaaatgctgagtgatgttctgcgtagagcagggtaggtgactttgaaagcagtcgagagtcagaaagttcagaggagcctgtgccaggggctacgcggctgtttcccaccgtcggtgacaaggatcgcatctccaggtctcttcgtcctggtctccccgtgtgctggggtcctggcttcccgtcaccttcacgcccatcattttcccaagtgtggacctttcagtcattcccactggtgagttgtgaaggcaaagaaatggagagtggccacaagtcagcacctggtggctttggcagaggctgtggggaaccaggaggctggggtgagagcagacgtggaggagcagcttgaagcagcctgggaagatgaggcctctacatggcaccgccagcagaggaagaagacatggcccacctgggaggtgagcaggaggggcacctgacagcgacgatgccccggtctcacagtatggcgtctgcccaggtccaatagttcagagtaaccatttcccccatgcgaccaggtaaagaaataccagaagcatttccagaagaattgccatgaaaattccagagagctgtttacaaggttcaagtgttttctttttctctttttgagaaagcatctcctctatcacctaggcggaagtgcggtggtacaatcatagctcactgcagcctcaacctcctgggctcaagcaatcctccacctcagccacccaagtagctgggactacaggtgtacaccaccacacctggctaatttttaattttttaaatttttttgtagaaacagagtctgactgtgttgcccaggctggtcttgatcttgggctcaagcaatcctcccactttggcctcccaaagtgctgggattacaggcgcaagccactgcgcctgactcaagattcaagttttaaggccccattggtcagaacaatgggtgcttctgcccaacctcgacggctcccaggggaggctgcagtatctgagccaatcacttaccagggatgtttcagatcagatgaggaggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcagttctctgcctgtgcttgctgcatcccctggctcacaagtcaaacttcaggcaggcaagaaggggaagaggtgtcttccttaaaatagcttgcacttgaatttgaaattgtctcagtccctgggctaaaaagagagaggccttttcctttctattgtagtgagaagaaaccaaagaatgttccagggaacagaaggtgctgcctgagttctgaatgtgggaagcacacggaccttctcacgcggttaggaggagccccttggacacctgtgtggttcagaaacgttgccacataaattgcacctgaggtggagaggctgtttgcacgatgaagtcgtgcaactgctctctgggatgctgacccatagcacagtgcttggcaccaatggatgaactagcacagggacggaaaccccactgggaaacatttggatgctgccttttcctccttgtctgtccaggtctccgaggtggagcgggacagcgagggcaggtgcaccttcagtgaaggcccaggccacacaagactcacggctctccctggtctccctgaagggccaaattacgtgcttaggaaatgcattctggcacatggaagaaacatattacaagtgtgtaaataatattggttatttttaaacaatccacttgccttcctaaactggtaagctaaaagagaagattcatattctagaattattcctattatgcttcatttggatgcagtttattgaccaaaatattccccttaaataccaaaacaacttgacactgatttttctgtctgaaagaaacactgttaaacctgaaagtagaatcttggtacataattctcctgggaccatgtatcaaatcgtaatttccaggccctgtgattgcaactgtaattttccatcgacagagctctctgccatacaacatgctttgatttaatcctcacaaaggctctgggaattaggtattattgttgctttgtagaaaaaggaactgctccccactgtcaatcatccagccaggagtctagctgcccagcctggcccggtggccattgttggctcgacagaggtgctgtctcttgccactgccagccccatcaccatcctgggaaggaggctctctagtcagccctataaacgcacctcctgaatatccatgaaaaaatcagcaagaaggcatttctgggaagttcagctgaggcccttattacaagacgagaagggtccagttccctggggctgtcaaggaagatgctcttccacactgccgctcgaggcgaccctcctctggtatcctgggcctcactgagatgcttttcctatctgcacagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtgagtgagtgcggtccctgcagctggtccccatgaactcttccttctttttttaatttttttaaattatattttaagttctagggtacatgtgcacaacgtgcaggtttgttacgtagggtatacatgtgccatgttggtttgctgtacccattaactcgtaatttacattaggtatttctcctaatgctatccctccccctgacccccaccccacgacagacgggatatgatgatccccgccctgtgtccatgtgttctcattgttcaattcccacctatgagtgagaacatgcggtgtttggttttctgtccttgcgatagtttgctcagaatgatggtttccagctgcatccatgtccctgaaaaggacatgaactcatcgtttttttatggctgcatagtattccttggtgtatatgtgccacattttcttaatccagtctagcactgatggacatttgggttggttccaagtctttgctattttaaatagtgctgcaataaacatacgtgtgcatgtgtctttatagcagcatgatttatagtcccttgggtatatgccaagtaattggatcgctgggtcaaatggtatttctagttctagatgcttgaggaatcgccacactgtcttccacaatggttgaactactttacagtcccaccaacagtgtaaaagcattccttttctccacatcctctccagcatctattgttttcctgactttttaatgatcgccattctaactggtgtgagatggtatctcattgtggttttgatttgcatttctctgatggccagtgatgatgaacattttttcatgtgtctgttggctgcataaatgtcttctttgggaagtgtctgttcatatccttcgcccactttttgatggggttgtttgttttttccttgtaaattggtttgcattttttgtagattctggatattagccctttgtcagatgggtagattgcaaaaattttctcccattttgtaggttgcttgttcactctgatagtggtttctattgctgtgcagaaactctttaattagatctcatttgtcaattttggcttttgttgccattgcttttggtgttttagtcatgaagtccttgcccatgcctatgtcctgaatggtattgcctaagttttcttctagggtttttacggttttaggtctaacatttaagtctttaatccatcttgaattaatttttgcataaggattttcgcatcgatgtttatcaggtctcacttctttcttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagatgcctgtagtcagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttctttatattcctttcccagtagtctgtaagtccttctgggagcttctaacctgtctcaaaagttgaccggctccaggcgtagtggggagtggggagggcaggggtgctgcagtgcgtccggcgatacctgcttagatgagagctgagtcatgcacagtgcaccagaggggcaagggccagcctggccctcagcaggtgcccggcatttgaagacacccaggtcatcccacacaggacgatgcatgtcgtgatttctaagtcttccttttgggcatcctaaggccaaaccgatcctttaaagactctggtggcatgcagtggtgggttcacacgccactgagatagaccgaccctgacaggccgtggggcctgctttccatgcggggcctttggagatgacaggaacagtggtccccaggcaccctggccactccctcagctaagctgagtcttcctttcactgttctggatgttagaattcagcaaacgcttcttttttttgtaatctttctgttgctgagaaataaaacaaaaagctttaaaaactggtgggctccttctccaggcccctttctttctgagggtccatcccccatgagccacattgtcagtgccagcccagtggttcacctgccaacaagggcagtgtcctgaggacattcaggaaactctggaatcacacaagctgaattcatgaacttacacgaaggtttgctgaggataagattgagctattgggctgggcgcggtggctcacgcctgtaatcccagcactttgggaggccgaggcaggcagatcaccaggtcaggagattgagaccatcctggctaacacggtgaaaccccatctctactaaaaatgcaaaaagaaattagccaagcatggtagcgggcgcctgtagtcccaattactcgggaggctgaggcaggagcatggcgtgaacccgggaggcagagcttgcagtgagctgagatcgccactgcactccagcctgggcaacagaaagaatgagactccgtctcaaaaaaaaaaaaaattgagatattgttgtttctctagaactgagccaagagctgtccttgccttgtgcatggtattttccaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggtctgccagttccttcccttgcacacctcatgcagctgctgcgggatttgccgagctagcaacctgctgctagagagactgatttagaggaaaacaatcacaaatctgaggccttctaagcaacggctcttaaagggctccagttcattcagctaaagtggccacttccagcttttcttagagatagaaatggcacgaagagggtggttctgaacctcccaggaacgtatgagctgggaccttgagaaacagccgcttctagtagagggaggagggagtgcgcgggcagacaatggcaggtctgtatctggtatcccgggaagctcctgggatggctagagtgcccccctccccttctcctccccaccacaaggtcccagagcctgcaaagatcattccgtcacatcaggactgctgttaactaactggtccaagctggcccctggcaggagtggctgctcctctcaggccagcagccccctgtgctccccacaccccacccggctcctgcctttcccaggccccacccggcagcctcctccctgacctgcccagtttccaactccctgacctcaggcccacctcagccttccctcctctgggctcctaggtggttcggttgtctggtcaacctgcagcacctgtctaggcccgatcccctgacacctcctattctgtgtgcagctctgttctctccacgtaccctgggagcttgggaggtgccctcctgttgtgtgtgggtgacatgtgagatggacagtgctggcaagtcctgccctgccccgtccctgggccttcctctgtcccctggcccttcccccatccctgtcttcctcaccagtggcatctggaagggctgggatcagcagccacacaggctgtgaatatctggggactaaatgtgagttgggaggatgcagaaggggcccctatgtgtgtcaggataacgcacactgtccccctcactccctgcacccaaacacagctgctttcttgttgccagagctcagggagcacagcctacacatgccttcacatgcccggcacatacccagcacacacccgcacatgcccggcacatgcccagcacatacctgcacatgcctgcacacacctacacatgaccagcacatgcccacacatgaccagcacatgcccagcacatacccagcacacacctgcacacgcctgcacatacccatcacatgcccagcacatgcccagcacacgcctgcacatgcccagcacatgcctagcacatacccagcacacacccacacatgcccagcacacacccacacatgcccagcacacacccacacatgcccagcacacaccttgcctctggctgggaccccctttgctgctggccctgctcaggccccacagcttgatctcctcatgttcccactgctgacttccccaagctaactgtgccacagagtgggggaccccctcccggctctcacaacccccaccttcctctgcttcacttttcaccaactgaaatatggccaaaggcaaaaacccatgttcccactggcctgtgggtccccccatagatcgtaagcccaggaggaagggctgtgtttcagggctgtgatcactagcacccagaaccgtcgactggcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttgagcgttggggacgcaaacacgagagtgcttggtgtgagcacacaggaggagtcacgacagagcagtgtaagagccgccacgtgggtcccacacagggggagtcacgacacagcagtgtaagagccgccacgagggtcccacacagggggagtcgcgacacagcagtgtaagagccgccacgagggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagctgccacgtgggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagccgccacgagggtcccacacagggggagtcacgacacagcagtgtaagagctgccacacatgggtccctgcggcctgcagttcgaagcccactgcatgtgttagcactctataccccagccaccgtagaaggccggactgcgatcactttctaaaagatggatcgagagactgaagcacagacagtttaggcaacttccccaggtctgaattccagcaactggaggcatcgatgcaccagaaaggccacaaacctggcagaggcttcattagatctgatcagttcgatctgaggataaatcagataaaagagaaacgctcatgtctcagcaagctgagctgtgatgatgatttccactacgccctgaaatcttttgttgtactttacggggaatataaaatgtacaaccttccccaaaacacttttttgctgctgggcacagtggctcacgcctgtaatccctgcactttgggaggccgaggcgggcagatcacgagttcaggagttcaagaccagcctggccagatggtgaaaccctgtctctactaaaaatataaaaaatcagctgggcgtggtggcagacacctgtaatcccagctacttgagaggctgaggcaggagaattgcttgaacccaggaggcagaagttgcagtgagctgagatcatgcctctgcactccagcctgggtgacagagcgagactcagtcaaaaaaaaaaccaaaaaaacacttttttttgcattcccgtttctgcagtgtctcccacaggcagggacatctaaagtgatgttctttcttcccagctctgcggcctctgaagctgtgatgagcttcagcctccatgtctttacctcctgcacaggccttgcatattttccctctagagttggaaaaagatgcaaatgtgtttcctcttagagcaataagaaaggaaattacccttctaacttcgttgttttttctttttgaaattaagatttccatctctcacaggtattagaaatgttttaattattttggactacttaaaacagtttgacaatggtctaaattgactatacagaaactttctctcctcatttgagaactttaatttgctcattattttggtttctcactagtctgaaaataactgcattcttttagtaaatatttaatgaaataactgctgtgtcccccaagccctgtggcaagcaatgggcgtctgttttctatataaaccaagtgtctacaggttacctattcctggagctgagaaatttgtggggtatgtttgggatggtctaggctacagtagattgggtgataaagatgaaattttgttggaggtgctgagatggagagacacagagcctcttgacggggcaaagcacttcccggtggctttgatgagagggctgggatggcccatctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcaggtgactctaggagcacaagagtcagacacacacttgttcctcctgagggtgaaccagggagccacctgctaagaaatggactcaatggcacctgacagcagttttctaaaagctcaggattttttttgttttttgtttttttgagacgaagtctcactcttgtcacccaggctggagagcaatggggtgatctcggctcacggcaacctccgtctcccaggttcaagcaattctcctgccccagcctcccgagtagctgggataacaggcacccgccatcacgcccagctaatttttgtatttttagtagagatggagtttcaccatgttggccaggctggtcttaaactcctgacctcaggcaatccgcccgcctcggcctccaaaagtgctgggattacaggcatgagccaccgcacctggcctctagaagcgcagattttgaatctcactcatgccttcctctttcactttgtccattcttccaatccctcttcttccaagttgttcccacccctttgctccatgagtctgtttaccacatgggcatccccttcccagaccaactggaggatgcctggctatttctcccagttctgtttggtctaaacatgagacaccaagaggcccaaccttctgtcccatgaaagcctcactgtccctggggggaaccagcccagtgctcacatgttgctgtgcgtgtgcttgtccaggacttctgctgggagcctgtggtgggcagggcgctgagagtagaaccagacagtcttagctaaagcaccacacagggcgggtggatgagtagagacagtagcagaggccctgggcggcgctctgatcagaacccgtgggagtgagggtcgcccatccttgaggagggagcacttctggaggaggtgacagctgaaccaagaggagtggatgagggacgaaggcagatgtgaggagtggggcacagggaggggcacgagtgtcaggcaaaggcgcagccacagagtcagaccatggacgggggcctgggcagggagcagctgaggcgtgggtcagtgagcaggaggaggagtgagaagagaggccagggattcaccagggctcccaggaagaaaagatctccagtcttcaatatggagatgagtggccagacagataaagatatttgtgtgtgtgtgtgtgagtgggtgggggggggggtgctggcttctgtgtgtgctcctgatgtcattgtgggaggcaaactctgaagaggatgcagagctgtgtcagttgccctgtagaggcaagaactaagtgcaggctgggcaataacaggaatgcacttagatgtcacggactcagcattcttgctgtctccagctcctttatgaacaaacctgcaaaaagagctctggcgtccgagctggaacattctagcctggcaaactgccgggcagtgtcacagggtgggacaggactctgcccggcatctgagctggaatatcctagcctggcaaactgctgggcagtgtcacagggtgggacaggactctgcccggcatccgagctggaatatcctagcctggcaaactgccgggcagtgtcacagggtgggacaggactctgccgggcgtcggagctggaatatcctagcctggcaaactgccaggcagtgtcacagggtgggacaggactctgccctgctgcgcttccagtctcggggaccatggcatgagtgagatgggctgaacaaaagttcagttctgtgagagaaaccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcgtcttccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaatgcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccagtgttaggattttggaacaacacagacaaaagcaataggaaaatgttttcttttgcttttaaatacatccctacctatccaattctctctctatttttggtagtcactgtgccgaggtcagatttttgttgtaaaggatctgtgttcttcccagagagtgcacctgccacacgctggggctcctgtcctttccccagtgtgacttttatctctaatttctgagatgcagcctttcaaagagctacgaacacctgggtagaaatcaccaggagaacttgtctcccttatagctgtgtcttcagcaaacgtgcggtttggaattctctgggacatgggaagccactcgctcagaagggggaagatttcaccagcttgccccatacgtgtgtctcccatgcgtgttttatgccacctgtggctgaagcgccatctgaaatcagtgcagaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtgggacttcatttcttcacattgcaatttttctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagtacctgcacctgagtggtcccgggtgctcaggggtctgggcagacgccacagggtctccttcaggtcctcagtgcctgcacctgagtggtcccgggtgctgggggtctgggcagacgccacagggtctccttcaggtcctcagcgcctgcacctgtgtggccccgggtgctgggggtctgggcagacgccgcaggagaggctggcagcacacagctgtgggcagctggtcttgagtgcctgccctgggggttctccatgcactgtgaccttactcactgtctccttctctggaggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaaggtgaagttcggtctcctctcacaccacgttacagcacgtgcatctcatcaaacaaagcttatcttccccaggagctgattttaacttttcactgtttagaaaatagtgtcaacgccctgccttacaccctcagggcagctcctggggcggggcggggcggggcggggcccttctctagtgagaaaggaactggaggcctagagaaagggagcccgcggggcccgatctgggaagaggccgtgtgtgctgcgtgggtgctcagtgagtgaccacagcagggctccccggccctggcaccagcccctccagggcacaagcgcacccgtgacagggacgttggtgtgtggttttcttttctcgtagtttgactacatgtcaacctgtccacatttcatagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaaggtcagtcctttcttcaatgacaattacaaaacatctgaatgtttccgatataagttaacaatgcaatgtcattgaaaatttcttcgccaaaaggtgcttctgaaactgttatcttcccaggagcaatctggggatagaaagcaagggctctccccttggctggccatgttcccagctggcctttttctaggtagtgaggcctcaggacaggcacgtggaatcgtgaccaatggggtcaccggtgagggaagagagaggggagtccgtgagttccaggcaaagttgtggtgaactcgcaggggcgctttctcaaagggaacacagcagcaaacgtctccactccaggaacccatagagtaaggctcgcctccacctccacctcctacaggtggctgattcccaagcccatgcctggtcctcctccagccactgggttccactcccagcctcccgcatgtttaggtgtggacaagtgtggcttcctggcggtaatttgagagcaggatggggaggcacctttcaggccgcaaggcaagacagccgtgggccacttccacctgctcctcccatgtgctggcttgagcgggtgtcagcccagggcacctgggagcaggtgtgctggacaacagagcctcccggggggagagccgtgtactggggttcctctgcggggaacagcagaatgagagtccccatctgactgttctgaggcagagccctctgggtgcgactcctgaggctggggcttcctgtcagagcagcttgcgtcctccaactacttcagaactgccctgccacaaaacctggaccgctggttctggtctcatgggacagtggcgtcagggcaggcaggagcaggaatggctgctgttctgggaggaaggctgctcagatgacactcaccagcaatctttagaaggccaaccagctgccttcagggactgcattttaggagaggaaagttggcatcagactcacagtctcctgtgagctacgtgctatgagctgcacttacctagaccgcagaagaaagagatggtctcgtgcaagaatctggctggtttgcaagcagaaatacaagcaaagtccacagttttcagttttctcagagttttcagaagatgaaagagtcctggagccagtgctttgggagacccaggtgagagaatcctctgaggccaggagttcaagaccagcctgagaaaaatagtgaaaccccatctaccaaaaaaaaaaaaaaaaaaaaagtggctgggagggggatggtgtgataagttgcacaaggtcagtgtgctcaatgccagtgaactgtacatttaaaaatggcagaggtggtaaagtttacattatgtataattcagcacaataacaaaatttccatttcaattttgaaagtccaaaatgtttctccttgaagggttgcagtggtcaactgcttccagaccctcagtcataaagggagaggctgagaccctgtgtgcaccagagacccaccaggactcagtgctgtggcaggggtcaggtaggggtgcggctcccgccaagtctgtggtctcaggtgccctcccgggagccaccttcccattagaagaggagagaagggatgaggagaggaagaaacaaagctggcctggggaacggtgcctcggaaataactttcaaactcactaacggcacaaggagctgcctgggcatggatagggcagaggcctgctacataggtgagggggtgtcatcactggaaaccagcagcctgggctggaaaccctctgtttaaactgttaattgcacaatgccagatttgcagacgtgctcccctgctgcattttgggattggtcatgaatgacagtgtacaaggagatcacccagagattacagtgccccagagaacagcagaccaggatgtttctcccagagaactttccagaagcctcggtgatagaaacacaactactctgtcgggtgatgacatctgtgtaaactcgtggttgctgttaacactattgcatgactcctgaccataggctctgccactgacacttcagtgacaaaagggtcacgaatcgcaaggttttcctgttcccttggcttagagactgcacaaacttgaaacggccacttcactcacgattcctggttttccgtgttggcattacagttaaggaattgatggcaggtgcttcagggtatagcatgttgcgtgttctacgttaacaagccttcctatggtgcacttcactgtacacctgcgtctctccttgcccaaatacccagacgtttcacgtgtccattttagcttcattttaagtatgaatgaccccaaagtgctactcacaggcatcttcaaggtgcaaataaaagatgggtgagaccttagagtggatcaggaagggagactgctggagtcctacaacctgcctgtgtggagctgccccctgtgcgcgtgccctctgaccttccgcctgccctctgaccttccacctgccctctgaccttccgcctgggacgttgctcatctgtctcctaagtgaggaatgctccttcagcctcctgtagaccatcctatgccatcaaaatcactcttctgttcttgaaattttttcatttatcttccttgatttttagtccaacaattaacagctgtctgaagttaagatccattgtaagaaggactatttctgaaccagtctgggtgctccccagggtgcaggggcctgtctcggcatggtgcgtgcacagcagccagtgctcctggtgggctccctggctgcagcaacatcaccaaggagcttatcacacctgcggcgtctggggccaccacaatccctgagtcagggctgcagcaacaacatcaccaaggagcttattacacctgtggtgtctggggcaccacaatccctgcgtcagaatccacactcttcacaagaccccatgagactgtgtatatgaaggtctgagacacccatcggccaaccctaactcatcctgtcttctctctctagttcactaacttgggcccaacttcatgttctcctgccacagacatttccgtagccatttaatctgtctcccaaattgctgagcctctgtgtgcctccacggtttcaaatgtgaaatgaggacaggaataaggcattgatttaaattagttataaatgcacagtacaaagagcggggtgcaggcctgttgatattaacactgtgagtgctcaggagccgtgttctgaatgctgggacagccacacccagaacaattacactacacagttagcagggcgtctgttgacttggaagagtgttggtgacatgtcactcaataagcatgtaagctacacagcaatgtgtacattgggaatctgttcgggttttttttaaagcagtgggccacaggcacacacatcactttgatgagtgtcctcccgaatgtgaggggagcgctaggctctgctccagaacctgttaatactggagacctcggcagcctgagatggggacaggtaggagagattgctaaccttcatcaatacaactcttttttttgtttgttttatcatatctgtaattaaaatatatcttagagataaatgacaaaactccaaaatctggtacaaatgcgtgtgcacagatatttttactacagctgttccctgcactagaagtttcaaaatcgagaatcacaagggaaaaaactcaagtataacagacaggaaactttacgtttatggtaaattgataagaatataagcactcaaggagatcctcagtgaaacctcatcaacacatctgcggctacagaaaggaaggctacgggcttaactgaatatttgatacagaaaaacaaatagtattcgctgctctcttctctattcaaattctacttattcactcaaactcattcacataaaaacttgatattaaggccgggcgtggtggtttatgcctgtaatcccagcactttgggaggccgaggcaggtggatcatgaagtcaggagttcaacaccagcctggccaagatggtgaaaccccgtctctactaaaaatacaaagaagaaaaattagccgggcatggtggtaggcgcctgtaatcccagctacccaggaggctgaggcaagagaattgcttgaacccgggagatggaggtttcagtgagccgagattgcaccactgcactccagcctgggcaacagagtgagactccctctcaaaaaaaaaaaaaaaaactggcaaatgcattgcagtgagtctcctctgagtgcctggatgctgcaaatttcaaatagataaaaagctgtgagtcagtggctttttccatgagttattgtcaggaggttatgcagtaaacgaatatacataaatgctttgtgcatattatggaaaatacagttcgcaaccagtactaatttacttagagaaatggaaacatctgtgcactcactgcatgtggagactggacaccacagccatctgcgcactcactgcgcgtggagatgtgtggacaccacggccactcttcttgaaactcaaggcgaagcagtcggagagcagagcctcggcctccatgcaggtcaccctggtatctggggacactgcggctgaggctggtttcctcctctgtcgggagcgctgctcttcagacaaggccgatttgtccccctccttcctgtccatcctgggaaggagacctacacagcgctggcccctgactcggccttctgcttagaagaaactgaccgtgggtggagcgttgtgggccaaactgtgcccccaaaaagctatgctcaagttctagccccgtgtacctctgcatgtggcctgatgaagaagcaaggcctttgcaggtgccgtcgagttaaagtgaggctgtcgggtgcatcctgctccaatgtgcagtgccctcataggaagcagagacaagacacagacgggaccctgtgaagacccaggatggaaataaagcttctgccaggcatgggccccccaggacccaccaggagccagggcatgcaggaaggacgccccccgactcccgagagcctgctgaaggagcaccacccggccgacaccctgatttcagacctgtgacctctagaactcttggaggatgcatttctgttgcttggagccatccactttgtgatgatttttcccagcagccacagggaactcataaggatgagtctgaactgcagggatggggtgaggagagggggcagaagctgctccaagggaactccccgagagggatgcagggatgtgttggcagctgccattcccattctgaggaccccattgcacatcccaggggatggagagaaaatgggcttgtagcgttcatgggtgatgactttgatttttcacacgatcatgatggaaacactccctaccccagaggcggctgcagatgccttcacacagctctggtgctccacagctctgcataacgggatgcaggaggggctggttccaggggcagctttagccaagaaagaccttctaggtttaacagccttgacatggttacctgtacatgaaacactttaatagctgctgctagatagagacaattaacagccgatagtcaatagctccaatcccttgaaatttcttgacccttttcttatacttctttttatttttttgagacagagtctcactctgtcacccaggctggagtgcagtgccgcaatctctgctcactgcaacctccgcttcctgagctcaagtgattctcctgcctcagcctcctgagtagctgggattacaggcacccaccactgcacccagctcatttttgtatttttagtggagatgggatttcaccatgttggccaggctgggctcaaactcctgacctcaggtgatctacccacctcagcctcccaaagtgctgggattacaggcatgagccaccggacccgacttcttatactcttatagaatggttgtcattatcaataatggcattattaaagaccgtactgtttagaaagcctgagatatccctgacaccctgctagttgtcataagcatcgtctttgattccacgcccatttttcacagctgacataatgatacccattctgtaactgagaaaaccagcatgggccaagcctcccccggggttaggagtgggcagtcccatccaatgcagcccctcaccctggggagcaggtggccagccgaccaccccagctggccttcgaggcctcacgggtctccggcactgggtcgcctgagcactgcccaggttcgcacattctcatcgtcctggggtggccgagtcggggaccaagaccctgtggcctatgtggaccccggctcctccactcagcggtgagactggggagggtccctccacctctcccagtgcttttgctctgtctagggatgtcgtcagcaccagggccccaggagtgcagggaggttgctgcctccagcctggccctcggcggaggctgcacccaggccagctctgttccctccagacagagcagctcctggaagagctcgtgttccccacactgacagcacctgctccatttagagaatgcgcactgggcatgtagagaagacctgtgacacgctacagcttcttttctaaaactggccagaaaaggaacattatttgaacaaaatgtacagcaggttatctggaaacatacgcctaggggatgagatactaggttgtaggattcttgtgcagggggagcaggagcaggaggggaccccacatcctcactggcggtggcaggtggccccagtccttgctctcagaggacctgccggccagctgggagcatctgcctgggcgaagcagaccctgccccaccctcaccctggccccttcctgcccccgtgtcctgcacttggccaaattccacattcccaggcagaccctgatttcctccaggaagtctcctgtgactcgggcctgagtgagccccagtgtgtggactccctgcaggctcagagcccgtggccagcgcacatctgtctgctcctcatcaccttttcggatgtgccgggagcagggggcggccggttccccctagaccaggtgggatggcaggcaaagggctgacctccccagagagaagcacctcccagaacgggggtcgctcgcgggagatgggggtgcagccgcttcctctcacgtgtgtggccttgtgtgtctggcagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtaggtgaggctgttcccctctctctctgtccgtccatttgcgagtttttgtaaaatgaagaaaagtgtgttcaagttaggcaactgtcaatcaccatcttgattgggaagggcggagatgaataagacaccaagcccacggtgcccgaggggcgtctgcgctgtgctgggggcagaggatgcacttcgtgtgcctgctgtctgcagagaccctcgaagcacactgaggctggggacggcagccagaatgcattgccagacaaggcccacaggtgtatacccagcctagatcacaccccagacaaaaaacctatgaaacaggcaggattcattacagacccatccatcacctctcctcctcctgggacccctccaaatgcacccgactgcaccctgaccagggccagcagcacagctgcctgcctgttctcccacctccacctccggatgtccccgcccggcatggggcctgggtgctcaacatctgcctcggatggccttgtccagtcccccagctctgcactcagctcagggacagcgtcttcctcaccgctgcctccaagccaggtgccagctacgcccaaacttttgacgaatttactcccctgaaaattgtggctcttaggtaagcactatctttaatcttcattttatagaagaggatactagtgataagagagggcgagagacgctcctggtcacacagccactccgtagctggccgggaatttgtgttaatagtctggcttccagctcttatagaaaaataattatttaccagactcaagttacagacagacttcctttgagctactgtcataggggagagaggtctccagaaagaaccaagtgcaaggctcaaatgcagcaaaggtagctgggacgtccagccagggcggagaggggtcagtgcaaaacgcttcatgactcaactgcattgaggagcttctgctaaactggaataataggattcttgctgaaactcagctcctcagcgaagggcacaagggccagggtcaaggccagttatcaagcaagtgagtctgaaaagagatggccaggacgcggctgcccggggccttcagaggctggggaggctctttctggggctctcaagctacatccgcttgactggcacgtcccccactcctgtgtcaggcatacacccccttcctgtgtcaggcgcaccccctcctgtgtcaggcgcaccccactatcctatatcaggcacatcccactctcctgagtcaggcacaccccaccagcttgtgtcaggcacacacccccacccccgtgtcaggcacaccccaccagcctgtgtcaggcacactgccccatcctgtgtcacgcacaccctcccacccccatgtcaggtgcacccctcttcctgtgtcaggcgcatcccccccaccccgtgtcaggcacacccccaccaccatcctgtgtcaagcacaacccccctcctgtgtcaggtacagcccccaacccccatgtcaggcacacccccactccttttgttgttgttgttgtttgtttttatttcttctaaaaaaaaagtgataaatgatgtgaagaacatgcaggtttgttacataggtatacgtgtgccatggtggtttgctgcacctattgacccatcctctaagttcctcccctcatcctccacccctcaacaggccccagtgtgtgctgttctcctttctgtgtccatgcaaaggaaccatttgtttacttaggggttgcggagaaattcttgtggctttctttttggcagtttttttttttttagttttattattattatactttaagttttagggtacatgtgcacaacgtgcaggtttgttacatatgtatacatgtgccatgttggtgtgctgcacccattaactcgtcatttaacatttggtatatctcctaatttaacatttggtatatctcctaatgctatccttcccccctcccccaaccccacaacaggccctggtgtgtgatgttccccttcctgtgtccatgtgttctcattgttcaattctcacctatgagtgagaacatgcggtgtttggttttttgtccttgggatagtttgctgagaatgatggtttccagtttcatccatgtccctacaaaggacatgaactcatcatttatggctgcatagtattctatggtatatatgtgccacattttcttaatccagtctatcattgttggacatttgggttggttccaagtctttgctattgtgaatagtgctgcaataaacatatgtgtgcatgtgtctttatagcagcatgatttatagtcctttgggtgtatacccagtaatgggattgctgggtcaaatggtatttctagttctagatccctgaggaatcgccacactgccttccacaatggttgaactagtttacagtcccaccaacagtgtaaaagtgttcctatttcttcacatcctctccagcacctgttgtttcctgactttttaatgattgtcattccaactggtgtgagatggtatctcattgtggttttgatttgcatttctctgatggccagtgatggtgagcattttttcatgtgttttttggctgcataaatgtcttcttttgagaagtgtctgttcatatccttcacccgctttttgatggggttgtttgtttttttcttgtaaatttgtttgagttcattgtagattctggatattagccctttgtcaaatgagtaggttgcaaaaattttctcccattctgtaggttgcctgttcagtctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccattgttgtttttgtcaggtttgtcaaagatcagatagttgtagatatgtggcattattactgagggctctgttctgttccattggtctatatctctgttttggtaccagtaccatgctgttttggttactgtagccttgtagtatagtttgaagtcaggtagtgtggtgcctcccactttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggtcattttcaccatattgattcttcctacccatgagcatggaatgttcttccatttgtttgtatcctcttttatttcattgagcagtggtttgtagttctccttcaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttctttctcctgcctgattgccctggccagaacttccaacactatgttgaataggagtggtgagagaaggcatccctgttttgtgccagttttcaaagggaatgcttccagtttttgcccattcagtatgatgttggctgtgggtttgtcatagatagctcttattattttgagatacttcccatcaatacctaatttattgagagtttttagcatgaagggttgttgaattttgtcaaaggccttttctgcatctattgagataatcatgtggtttttgtctttgattctgtttatatgctggattacatttatcgatttgcgtatgttgaaccagccttgcatcccagggatgaagcccacttgatcatggtggataagctttttcatttgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattcccgctttttgtattgattggaatagtttcagaaggaatggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaagaagtatgtgtcgaggaatttatccatttcttctagattttctagtttatttgcgtagaggtgtttatagtattctctgatggtagtttgtatttctttgggatcagtggtgatatcccctttatcattttttgttgcgtctatttgattcttctctcttttcttctttattagtcttgctagcggtctatcaattttgttgatcttttcaaaaaaccagctcctggattcattaattttttgaagggttttatgtatctctatttccttcagttctgctctgatcttcgttatttcttgccttctgctagcttttgaatgtgtttgctcttgcttttctagttcttttaattgtgatgttaggatgtcaattttagatctttcctgctttctcttgtgggcatttagtgctataaatttccctctacacactgctttgaatgtgtcccagagattgtggtatgttgtgtctttgttctcgttcgtttcaaagaacatctttatttctgccttcattttgttatgtatccagtagtcattcaggagcaggttgttcagtttccatgtagttgagcggttttgagtgagtttctgaatcctgagttctagtttgattgcactgtggtcggagagacggtttgttatttctgttcttttacatctgctgaggagaggcacacccccactcctgtgtcaggcacacccgccctcttctttcagggacaccacaccctcttgtatcgggcacaggataccctcttctttcagggacagcacagcctcttgtttcagggacaccacaccctcttgtttcagggacaccacatcctcctgtttcaggcacaggataccctcttgtttgagggacaccccaccctcttgtttctgggaaaccacaacctcttgtttcaggcacaggataccctcttgtttcagggacaccccaccctcttctttcggggataccccatcctcttgtttcaggcacaggataccctcctgtgtcaggcacaccccaccctcttctttcaggcacaccccaccctcttgtttagggcaaaccacactctctggtttcaggcacaccccccttcttctgtcaggcacagcccaccctcttgtttcagggacaccccacccccttctttcagggacaccctacccttttgtttcagggacaccgcacctcttatttcaggaacaggacaccctcttgtttcaggcacacacaccctcttgcttcaggcacaccccactctcttgtttctgggaaaccacaccctcttgtttcagggacaccccaccctgttgtttcaggcacaccccccctcttctttcaggcacaggataccctctcgtttcagggacaccacaccctcttgtttcaggtgtcctctctctgcacagcatttccccctcacactcattgttttatcagcctctggttttattcatgttttttctccatatgaaatagtatcctctcttcctttcaaaccagagcactctcaatcatggaaaattagaaacagcagctcttgcattcagatttttaaataaaatgtttaaatcaatggttcagatgtgaattgcaaaggtagccaggtagcgaagctgccacattcacagagaggagctcagctgctttccgcattattattacaaacctaagaaagcggattcagaaccctgctcaggtgaaggcagtggggcatttacgtcaagactgcagttttgctggactacagcccagaagcacttgctgtatttttgataatatctaaccctgtcagatggctccatggggccccaggaaacacttctactgctgtactccagctgaagccaccaccctccatccctcccaatgttttcttctggactcacccacagaaagaaggagaaaggagtcccagtggaggtcaggaacagccctgggagagcacccagagatgaattcgtgcctaagagggctcacccactacgtctcttcctcctcccggagagcacccaaagatgtgttggtgcctaagagaacttgcccactacctctcttcctcctgggccccctttgaatgcctgcaccgtgaccggggccaggagcacatgagcctaagaccattctgtgcaccagggcccatgtctgagagattaatacacaggtgcccagggcttctcctgtctccgtggtgatttacagacttagatttagatacagatattgattatggatagagacagtttagatataggcacagatgcagatatatagatatagatataaatttacatataggtataaaagaatagatttagatttcggtacaactctccctatataagtttagacgtagatacacatatagattcaggcatcgatataaaagaatagatttagatttcggtacagctctccctacataagtttagatgtagatacacatatagattcaggcgctgatataattatagagggagctctgcttttgcagtgttttgttcctaacgttgcggttaaaggaactgtattcatttcctgggggtgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccactgcaattacctcctcaaatgctccatccccaaatcagccacattctgaggcccagggtgttggggattcagcatgagaatctgggagacccggttcagcccacgacagccaattggtccatagtgccatcttttaatcttcagaataaaactttagaagaagtgtatacaacaggagcatgagttgcataaactaatttccaatattttgtttcaaacgtcttgttttagtttttgtcctgagaacaattacaacatacatttatctatttcctgcatcttttttttttttgagacggagtctcgctctgtcgcctagactggagtgcagtggcgcgatctcagcccactgcaagctccacctcccgggttcacgccattctcctgcctcagcctcccgagtagctgggactacaggcgcccgccaccacgcccggctaatttttgtttttgtatttttagtagagacggggtttcaccatgttagccaggatgtatttcctacatcttaaggactcttttctataaacgctgaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctgccttctggttctgtgtgatggatgtgatgcttgcatggtgctgtccctgccccgctccgcccctgctgggctcctggctgccgaacctgaagtcagggtccgccgcagaacacgtcttcccgctgagccctgcagcccctcaagcagctggctgcctccgaggagcttcctctccgacagctgccgtgtacctccctgacctccctggctgtgactcaggccctccggaggcactgggccaggccgccggtggagcctgatggtggacgatggtggacagtgaccttctccttctaaggaagggactgagggagggaaagtgcccccagagcatctcaggagctgggaggtgaacagctggggatgctggcttcagtgcttcccccaccaccagcacccttatgattatactgctgcccctgcaaaaatgaccatggaaaattaggatgctgggcatgacctttctgcatccctgacgcacaagcctaactgttgttgcacggaggccacacacgtccctgatgaaagagccctgctcccgtgcaagcagccgtcagtgccctctccgtacagatggcgcagccatcagtgccctctctgtacagacggagcaggccagcaggacccagcactgtccctggatgcaccagctctgtcactgctggctggaacacccaaaagggtgatggacatggctgtccctcagttttcagaatgacagcgtgaaacccaagcctgcctgcatgaggaagggtggacacagacagcagcagaggcctcggctgagtggacatgcgctcaggtgctgagggctgagagtgacccaggagcaacagctgagccatatttacagcccctcctacgagccctggctggaggccagaggttccagggaaggtgggcaccagggcccatgtctgagagattcataaacaggtgccacggcttctccttccgtcctcacagtgactcacagacaaggatgccaaggcctggaagatgaggcatggctgtgagaggagctcacactcccctggcctgcgagagctctggccccggccagcccgtgtgctgatcgtattagacggagtctccagagaaacaggagcaatcagagatgcagatgtatgtatagaaatagttatagattagagacatccatagagacacagtttgtagatgtagttacgtagatttagatatagatatcgatttaaatatggatatatgtagatatactatatatagatttacatagattgaacatagatatagataacaaatatgtagacatagatatagttatactgatttagatatagatactgattgtgggtatatatagttttaggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggcagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacctgaattctccaaaatcccagtgccctctgtctgcccagggcctgcccaaacccgatgccgtttctttccaaaggccctcgttggccttcacccagcctcagggactcccccttgcccagccccaccagaggggcacccacgcccacagcagagaactccagggctccccggggtggcactgaagaggtcggaaagccactccggcagcagccgtgacctttgtgatgcccccgtaggacatgcaggggcttcaggacctgtctcagctgggtatctcccagaagcacacagccttcaatctggttccaagcggatttactggctcttgaaattgaaaatgccaagaaacaaaaatttggagcaaagaataaaggaaagtttctgctgtgcggcatctggccttccccctgcccaggctcgtttcacacttttgggtaaacatggagctgcttacgtccctgctgtgggtctgccgtttgctggtgtgaggtgggcttcaatcagatgctcgccacggcccaggacgtggctcctcctctcactcaaggctctgatgtcagatgcctggctttgctggtttttgaagttccacaggtggcccctccagcccaagtttctcagaaccaaatccagccggaaatgtcaaacaccaattccagaatgaatttccacggctgccctgtcctgactgccctgacctggcctgtgcttacctggaattcccacccaggcctcgatcagctcagccttccccgcacccccagccccaggcacacaggcggagcccccacctctagcagccatgggggtgagagcgagtagcagcagatggaaacaagaacccagcctctttctggatgcaggaggagcggcatcccagggccagcaagcagctctgctccccatgggcttttagcaagaggctggtgtgctcaggttgccctgcagactcccctgcgtctgtgaaaggtggcaggaaggagatcctggaggcgggaggatggttagaggagcccaggaggaaaagtcatgaggtgcaaaggctaagaggacaggatcgttttggagaaacagtcaggatgcgcatttagggtttattcattcattcttgtatccaacaaatgcttgctgagtgtccaagacccatgcgaggaagacagccacggacaccacctgtgtctgggctgggaaagacccatgataggaagacagccatggacacgacctgtgtccgggctgcaaatgagacacacctgcaaatcatgcccaggtgctaagtggcacagggaaccgcagtcacccacagacgcattcatcaccgactttaaaaaatccagtgtgagaaatagaaccaaaccaagcacccattcccccagccgctgcctctgtctggtacctgaatgtgctctcttagccccagagcctatcttcaaccacacgtgatgatgtttatccagggcgacccatgtttgtttaaaaaaaaaacgctgattggtagtatttaaattcttatttaaaagtcagttttcgtttcatcttggatttctcctcggccacctcgaatgggtatccaaacagaaaagtcggtaataaaactgtggtcaaaggagctctgagttcagagccgcagtggccccaggctggcagctccttgcagaaagcacagaagccaagggctggagcccaggagccgttactcagtccccggctttttcagatgaagacacaggtccaggtgggaggcacttcctcaggcccctcaccagatgctctggggccggctcctgggctgcctctctcctctgtcccatcaggcctgcacttctctgtctgattcccaccaaccttgttcggtttctttctggaattggctgatgagacccaggatgagctccaaaatctgctgccatcccgtgcccccgtccccccagggctccagctctgcaaggtgctgtccaccttccttcaaccacggtttcacctccaggaggcttctgggaaagataaaatgcagccaagggcaaaacctcacagcgttataccgcgtcccttacagcccaccttgcgaacctttcccgccccggtccgaggcctccagggctccctgggtcctgtggtccactccgagggcactgagagccctccctggtttgggcagcaaggtgtgctttctgtcctgcaggacgcgtccatgccgaacccacagtgaggttccatagagagagctaacttctctgccctgtgtcccctgctggctctccccacacacgtcacattcggatctggacttagtggtctaaatggcttttctgggcagataaatgtccctccctccctgcgtcatgctgtggggtgaaggccactggcccaggacagggtatggcccagactcaggcaggacaacctggcttgcccaggccctggaaggttcttctaaccaggcctctttctgtgccccagactccgggaggctccctcgggtgacttggatctccatgtcgctggctgctctgctgatcggaggcttcgcaggtctcacctcgacggtgatttgcaggtggtaagtccttcactttttgactgttacttagacacaaagcaatctcctttcctctggacatggctgcaatgaagctgctttattttcccgaagctaacacaggttactggtatctcaaaggcattgatctcagagctattttgtacaacgtaatagactctccggatctttcattatgctttaaataatgaaagtggagtgatcatttgtacaccttaggtggtgtcaggtatctgtggacgaacattcagcaatatggaacacttttctaacactaaatgattgcattgaagtagtctcttgttaggagtaaagattcttacaaaggtttctcagagaaaaaaggtcatccatgaataaaaagttttattcttcagttttattccctcccttgagggcagaaattggaagttgaactttcatgttaaaaatggcgctgctgttgaaagactcagacccgcacctgagaggccctgccctgtgagagtgctctctgcagaaagagcccctcgaggcttcctcaggtgcggcagctggtccatgtccctagccctgaggaaccggctctgttccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctcttgagcaccaaactccttgagcatcccttccatttttaatgcacaattgttcattttatatagacagtattaaaaataacagcaaacactataagaagtcattgcaggcccaggctgggcccccagggccatgcccaggatacctgcagatagaggccacagtttctcggcttctgctctccctgagtgccaggctcccccccccaatatgccctgtgcacactcctgctgcagccagccctgccctctgccaggatgacccctgcagtcaccttcgccctccaccccggccttcagagctcctcactggcggagcccccagcaccaccccataccacacatgtatggattatccaagcctcccagcctcacccgataccacatatctatggattatccaggactttcccactctaaggccatcttccagggtgtttctcatcttcccaataatagaaactcaacattctagcaaacttcatttttctagcaacttctcagtacactgaggaacatctgccccttgaacaggaaatctttttcttacagtctttgcacctcctacaggaactggtttttaaaaacttgaaagcttagcaaccagatgttacccatgatctttatcgtttccaaagggccttgtcaagaatccacagttaatggactcttttctgttgtttttatttttgtgatcacttgtaagggaagactctgtacctgccatctgctctgcatcctgtctctctggggctgagatatggtagtaaagccagttccccatttcagttattctgcaaggcctctgacaactgctgtggttgacccagatgcctgcatttgatgcatgagcttatgatctatccggcatatgatatttcagtgacgtatttctgagtagcttcatagcttctaacaaaactaacatacaccataattcagacaactgtgagaaattccttccagtagagaggtgatagtaatggctaaagccatgtgtcagatgtaatgctaagtcatccttagccactgtctcctctgattttctgatcaatcatctgactcaggtgcttgccatggcttgaactgtgcattgcccagaacatatgtttatatcctgacctttaggacctcagaacgtaaccttatttggaactaaggtctctgcaggtgtaattagttaaaatgagactgtcctggagtagaggggcccctaattcagtatagctggtgttcctctagaaagaagagtttggacagagtcatgctgagcaggcgaaggccatcttgacgggaaggcagagatcagggtggggtttctctaagctggggcctgggaagatcgccagcagccacaggaactgggagggaggccgggggagccgcctgcaggcaccttgatgtggactcctgcctccagagctctaggtcataaactgctgtttaagcagccaagtctgtggtcctctgtgactgcagccccagaaaacttaatgaagtgctatgattgtgtccattttcagtgtagcatgtggaggtggagcgagagcctgttacttgctcaaagctggtaggcccagagcagatccttgaacccaagacctgtctggtgctggaggtcgtgccacagctgccctgcttctcctcgcgagaagattatattccacatgccagggctgttgtttcaaataatcattaccagtgaagattgaataatcacctactctctctacaagacactatactgatctgttttggaaagagagtactttaacctttaaatggtgtctctagttttagatggggtggtggcaggaaatattccctatgttttatgaatcatttggtctttaaaccttaaaaactttaataactaataattaaaaccctcagctaaccatgaaatagactaagcaataaaaattgaataggctgtaagcaaataacttcaaattagctggttctgtaattagaactatgaaatgtataattgtaacaaaaactgatacgactataatttcctattcataaacaattttgtatttgcaaacatccctataaacatctatcacattatcattataataaatattagtgtctgtagcccacactcacaagaaaaatagcaattttctttaagattgacagccatagatgaaatgaatacctttccaagggaacttgggagagaaatatttggctatagttgattttagactctggagttctaaaaatacgctaccaagcaccaatttagtttgcaaaatgccacttagctgaaagatatgaaaaagtggatgttaatgtgccatcacacgcttgagaacacaggcagttacagagtcagagaccataacagggaagaccctggggctccagggcagaaacatcctggaccaaaaccacagcacccccagacctgtgattaggtgagctcagaaggtcaagtcactcattaggaaatgtcttcccaccacctaccctgagacccctattctgctcccagcaaatgggctcaacacaatcccagcctcgcctccctgtgtcttattcttcagcttttaaaaacatgatcttatttccaccttagggcattattgtgcggtgaggagtagggaggagaacagagagggataggaagaaagagagacagagacagcagagagagacacgggaggggagagaacccagcacggtgtggcacacagcaggtgctcagcaaacacgtttcctctcctagtgagacaaaggtgtttgcttctctactctcctcgttttctacccaccctgctgtctggggtctcacactgtatgttttggtgtgattgttattaatgtgacaaattgttgatatattttcactgcaaatctacgattcggagttaactccatgaaaccaactcctccatcaactttcttgacactgcatttaaaatacctccacggtattatgcttgttttattgcattgaaattgttttcaccaagttgaattctttctgtgcaaacttttacactaaaaattcattcctcaaatcagttctttggtccatgtcagttttgccaattagacctttcgccatggaggtgttttcctttgtgttatgatttcttcagatccggctttcttagctcagcattttaaacttaaatttcatgaagactttgtctgtctgttgattcttactgtccagggaagatgctaaatgtgcagttccagtcctttctccattcgctcttgtttttattatttttaccaattctacttttccaccatcacttagttctgcaatttctgaaatacaatttttcaggttttccttgtcgttgataaacggtgccctatacctttttgctgttttcagttgtattttgtattgatattcctacctatggtatgcattataaattcaagaaagtttgaatcatttgcattaatttccagcaaatccatgggaaagccgcgaggtccttccctaggatgcagccaggtttgtcctccgtccaggacgtctaaccctttgttccctcctgcaccttcccacgctgtgagctgacgggtgctgtttctctaggcacgtcacggggggttcctgccatctctcctctctttatcattagattcataagcgtgctggagggaggccagctgggactaggccgaggcagccatggggcagtgggccacgggatccctgtaagccatgggtgaccgggtgccctcttcccccaggaccctcctccccagggaccctcctcccccagggccctctttccccagactcttggggtagagacggcctgagtctcttgagatggagtctgaagcttctggtcatctgaactgcatgttgatgacaggaattgtcttcaggacgtcattagggaagtccgagagaactggccctttgctgggggacagacgtagagtggccagcctgggctacacagcatgggggatccgaacctgttgtagtggaatccttcagagtcagtacggcgtctgtgaggcactcaggccccagaggacctggggaaggacctgcgctccttagagacccacgtctgccctggaaatgagcagggggagctgttcccagcctggtcacacatgaaccacagcaaggacagcctcccaccccagtccccccgtgggttcagctaaacgcattgtccagtttccagcccagaacccaagcctggctgccaggctcatctgctttctctgggcagctcccagcccctccctctgtggccccactttcttcacccacttctgagcaagtataggtgggaaatgtgccttcctccctctcctgaccccaggctgtctactccacaccggccctgccaccgtgccctggcagtctctctacccgacaccggccctgccaccgtgcccttacagtctctaccccacactggccctgctaccatgccctggcagtctctctaccccacaccggcccgccaccgtgccctcacagtctctctaccccacacctgcccgccaccgtgccctcacagtctctctaccccacaccggccctgccaccttgccctcacagtctctctaccccacacctgcctgccaccgtgccctcacagactctctaccccacaccggcccgccaccgtgccctcacagtctctctaccccacacctgcctgccaccgtgccctcgcagtctctcttccccacacctgcctgccaccgtgccctcacagactctctaccccacaccggcccgccaccgtgccctcacagtctctctgatctgtctccctctcctgcccccagaccatctacctcacacaggccctgccaccgtgtgatgcccagccattcccacttcttggcttttattcaagcctcaatctctccatagaatactccctccttatcatctcaacctggcttcgaatgttcaagtctgacacatcgcaaaggctacacccaaacaccacccactgtctgcaacctccccaaacccccactgtatgcaaggtcctcaaatccccccactgtgtgcaacctcctcaaatcccaccactgtgtgcaaccccccaaatctcccccactgtgagcaaaaccccaaatccccccactgggtgcaacctcctcaaatcccaccactgtgtgaaacctcctcaaatccccccactgtgtgcaacttcctcaaatcccctccactctgtgtaacctccccaaattccccccactgtgtgcaacctcctcagatccctcccacgctgtgcaaactccccagatccccccaactctgtgcaacctccccaaatctccccaactgtgtgcaacctcaccaaatcccgacactgtgtgcaacctccccaaatcctgcgcactctgtgcaacctccccaaatccgccccaccctgtgcatcctcccaaaatcccccacactgtgtgcaacctcctcaaatccccccaactgtttgcaacctcccaaatccccccactttgagcaacctccccaaatccccccactgtgtaaaacctccccaaatccccccactgtgagcaacctccccaaatccccccactgtgagcaacctccccaaatccccccactgtgtgcaacttccctaaatccccccactgtgttcaacctccccaaatacctcccattgtgtgcaaacaccccaaatccctcccactctgtgcaacctccccaaattacccccactgtgtgcaacctcctcagttccctcccactctatgcaaactccccaaatccccccgactctatgcaacctccccaaatcccccccactctgagcaacctccccaaatccccaccactctgtgcaacctccccaaatcccccacactgtgtgcaaactcctcaaatccccctactgtgagcaacctcctcaaatcaccccccactgtgttcaacctcctcgaatcaccccactgtgtgcagcctccccaaatcccccccactgtgtgcaacctcctcaggtcccccactgtgtgcaacccccccaaataccgccactgtgtgcaacctcttctaatcccctcactgtgtgcaacctccccaaatccccccactgtgagcaaactcctcaaatccccccaactgtgtgtgagctccccaaatccccccagtgtgtacaacttgcttaaatccccccaactgtaatcaacctccccaaatcccccctactgtgtgcaaccttcccaaatccccccactctgtgcaacttccccaaatcccccctactctctgcaaactcaccaaatcccccccactctgtgcaaccttcccaaatcccccccattgtgggcaacaacaccaaatcctgccactgtgtgcaacctcaccaaattccccccactccgtgcaacctccccaaatacccccaactctgtgcaacctcccaaaatcccccaaactgtgtgcaacctcctcaaatccccatcctgtgtgcaacctcctcaaatccaccccactgtgtgcaacctcctcaaatccccccactgtgtgcaacctcctcaaatctcctcacagtgagcaacctcctcaaatccccacactgtgtgcaaccaccccaaatccccctactgtaagcaacctccccaaatccctccactctgttcaacctccccaaatcccccccactctgtgcaacctccaactttccctcccattgtgtgcaacccccccaaatccccccactgtgtgcaaccccccaaatcccacccactgtgtgcaacctcctcaaatcctcccactgtgtgcagcctccccaaatcccacccactgtgtgcaacctcaggtcccccactgtgtgcaacccccccaatccccctactgtgtgtaacctcctcaaatccgctcactgtgtgcaacctcctcaaatccccctactgcctgcaacctcctcaaatccccccactgtgggcaacctccccaaatccccccactgtgtgcaaactccccacattccccccagtgtgtgcaacctttacaactctactcactgtgagcaacctccccaaatcgccccactatgagcagcctcctcaaatcccccaactgtgtgccacttccccaaatccccacattctgagcaacctccccaaatccccccactgtgatgtaacctcctcaaattgcccgcactgtacaacctcctcaaatctcccccgctgtgtgcaacctcctcaaatcccgactctgtgcaacctccccaaatccccccagtgtgtgcaacctccccaaatccacccaactctgagcaacctcgccaaatcccccaactctgtgcaacctccccctatccctcccactgtgtgcaacccccccaaatccccctactgtgtgcaacctgctcaaatccccaaactgtgtgcaacctccccaaatcaccctcactgtgtgcaacctcctcaagtcccccactgtgtgcaatccgcccaagtccccccactgtgcaacctgctcaaatcccctcactgtgtgcaacctccccaaatccctcacactgggtgcaacctcctcaaatcccctactctgtggaacctcctcaaatcccccccactgtgtgcctcctcaaatcccctcactatgtgcaactccaccaaatctcccccactgtgagcaaaaccacaaatccccccaatgtgtgcaacttcctcaaatccccccactgtgtgcaacctccccaaaaccccccactgtttgcaacacccccaaatttcccccactgtgagcaaacccccaaaacccccactgggtacaacctcctcaaatccccccactgtgtgtaacctcccaaaatccccccactgtgtgcaaaccccccaaatctccctatgaccaaaaccacaaatccccccactgtgtgcaacctcctcaaatccccccaatgtgtgcaagccccaaaatcccacccactatgtgcaacctcccccaaatccccccgactctgtgcaaactccccaaatcacccccactctgcaaactccccaaatctcaccccactgtgggcaaccacactaaatcccgccactgtgtgcaacctcaccaaatttccccgtgtgcaacctacccaaatgccccccactctgtgcaacctcccaaaatcccccacaatgtgtgcaaactcctcaaatcccaatactgtgtgcaacctcctcaaatccccccactgtgcgcaacctcctcatatcccccgactgtttacaaccttcccaaatctccccactgtgagcaacctccccaaatcccccactgtgtgcaacctccccaaatccgcccactgtgtgcaacctccccaaatccccccactgtgcgcaacctccccaaatcctcccactgtgcgcaacctccccaaatccccccgactctgtgcaacctcccccatccctccatgtgcaaacctccaaatccccccactgtgtgcaacctcctcaaatccccccactgtgtgcaacctcctcaaatccccccgatgtgtgcaacacccccaagtcccccccactgtgagcaaccaccccagtccccccacagtgtgcaaacaccccacatctcccccactgtgagcaaaaccacaaatccccccagtgtgtgcaacctcaattccccccactgtgtgcaaccccccaaatgccccccaatgtgagcaacccccccaaatcaacatgctgtgtgaaacctcaaatcccccaactgtgtgcaacctccccaaatcccctccactgtgtgcaacctcaagtccgccactgtgtgcaacccccgcaaatcctcccagtgttcgcaacctcctcaaatcctctcactgtgtgcaaccttctcaaatcccacgccactgtgagcaacctccacaaatccccccaactctgtgcaacctccccaaatctccccagtgtgtgcaacttccctaaatcccccaaactgtgttcatcctccccaaatcccccccccactgtatgcaacctccccaaatcccacctaatgtgtgcaacatcctcaaatccccaccactctgtgcaacctccccaaatcccccccaatctatgcaacctccccaaatcccccccaatctatgcaacctccccaaatcctccccactctgtgcaacctccccaaatcccctgctttgtgggcaatgtcacaaaatcccccggtgtgtgcaacctccccaaatcccctccactctgtgcaacctccacaaatcccccacactctgtgcaacctactcaaatccccacactgtgtgcaacctcctcaaatcccccccactgtgtgcaacctcctcaaatccccccactgtgagcaacctcctcaaatcccctcactgtgtgccacctccccaaatccccccactttctgcaacctccgcaaatacccccactgtgtgcaacctcctcaaatccccccactctgtgcaacctcccctatccctcccactgtgtgcaaccgccccaaatcccccaactatatgcaacctactcaaatccccccactgtgtgcaacctccccaaaacccccactgtgagcaacctccccaaatcccctcactgtgtaacctccccaaatcccctcactgtgtaacctcccaaaataccccccgtgagcaacctccccaaatccccgcactgtgtgcaaccaccccaaatcccccccactgtgtgcaacctcctcaaatcctccgccactgtgagcaacctcctcaaataccccactgtgtgcaacctcctcaaatccccccatctgtgtgcgacctccccaaatcctcccagtgtgtgcaacttccctaaatccctccaactgtgttcagcttccccaaataccaactgtgtgcaacctcctcacatccccaccactctgtgcaacctctccaagtcacccctactctctgcagactccccaaatccccccccaatctgtgcaacctccccaaatcccacccaattgtgggcaaccacacaaaatcccgccactgtgtgcaacctcaccaaatttctcccactctgggcaacctccccaaatcccccccactctgtgcaacctcccaaaatcccacacactgtatgcaacctcctcaaatccccatactgtgtgcaacctcctcaaatcccccccactgtgttcaacctcctcaaatccccccactgcgtgcaacctcctcaaatccccccaatgtgagcaacctcctcaaatccccccactgcgtgcaacctcctcaaataccccactgcgtgcaacctcctcaaatccccccaatgtgaggaacctcctcaaatcctcccactatgtgcaacctcctcaaatctccccactgtgtgcaacccccccagatctcccccactgtgagcaaaagcacaaatcccccactgtgtgcaacattcctcaaatccccgcactgtgtgcaacccaaccaaatctcacccactgtgagcaaacccccacatccccccactgtgtgcaacctcctccaatccccccactgtgtgaaacctccccaaatccccccaatgtaggcaaccccccaaatctcccccacagtgagcaaaaacacaaattcccccactgtgtgcaacctccacaaatcctcccaagtctgcaaccccccaagtccccccattgtgagcaaccaccccaaatcccgccactgtgtgcaacctcctcaaatcacccggtgtgcaacctgctcaaatccccccactgtgtgcaacctcctcaaatctctcaactgtgtgcaacctcctcaaatccccccttctgtgcaatttccccaaattccaactgtgtacaacctcctcaaatccctcccactctttgcaaactccccaaatcgccccactctgtgcaaccgccccaaatctaccccagtctgtgaaacctccccaaatcccccccactgtgtgcaacctcaccacatccaccactgtgtgcaacctccccaaatcccccctaccttgtgcaacctccccaaatcccacccactctgtgcaacctccccaaatcccccacactgtgtgcagcctcctcaaatccccccactgtgtgcaacctcctccaatccccccactgtgagcaacctccccaaatcctcctactgtgtgcaacctcctcaaatcccccactgtgtgcaacctccccaaatcctctccactgtgtgcaacctcctcacgtcccccactgtgtgcaacccccacaaatcctcccagtgtgcgcatcctcctaaaatccccccactgtgagtaacctcctaaaatccccccactgtgagtaacctcctcaaatcccaactctgtgcaacctccccaaatctccccagtgtgtgcaacttccctaaatccccccaactgtgtttaacctctccaaatccccccactgtgtgcaacctccccgaatccccccactgtgtgcaacctccctgaatccccccactgtgtgcagcctctccaaatcccccccactctgtgcaacctcctcaaatcccccccactgtgtgcaaccgtgctaaatccccccactctgtgcaacctcctcaaatccccccactgtgtgcaacctccccaaatccccccactgtgtgcaacgtccccaaattcccccactgtgtgcaacctccccaaatccccccactatgtgcaacgtccccaaatccccccactgtctgcaacatccccaaatgcccccactgtgagcaaccttcccaaatccccccactgtgtgcaatctccccatatccccccactgtgagcaacctccccaaatcccacttgttgcaacctccccaaatccccccactgtgagcaatctccccaaatgccccaccgtgtgcaacctcctcaaatcccccaccactcagagcaaccttctcaaatccccccaatgtgagcaacctcctcaaatccccgtactgtgtgcaacctcctatcacccccactgtgtgcaacctcctcaaatccccccactgcgtgcaacctcctcaaatccccccactgtgagcaatctcctcaaatccccccactgtgtgcaacctcctctaatccccccactgtgagcaacctccccaaatccctcccattgtgtgcagcctccccaaatccccccgacgctgtgcaacctcccaaaattgcccccactgtgtgcaacctcctcaaatccctcccactctgtgcaaactccccaaaccccccccttgcagcctccccatatccccccaactctgtgcaacctcccgaaaacacccctcactgtgtgcaacctcgcccaatcacgacactgtgtgcaacctccccaaatcacccccactctctgcaacctccccaagtctcccacactctgtgcaacctcctcaaatccccccactgtttgcaacctcccaaaatctccctatgcgcaacctcgcaaaatctcccccactatgtgcaacctcctcaaatccccccactgtgtccaacctccccaaatccctcccactgtgtgcaacctcctctagtcccccactgtgtgcaccccccaaaaatccccccactgtgtgcaacctcctcaaatcccccgccagtgtgagcaacctcctaaaatccccacactgtgagaaacctcctcaaatccccccaagtgtgtgcaacgtccccaaatatccccagtgtgtgcaacttccctaaatcccctaaactgtattcaacctctccaaatccccaccactgtgtgcaacctcccgaaatcccatcaactgtgtgcaacatcctcaaatccccctcactctgtgcaacctccccaaatctcccccactctgtgcaacccccccaaatcccccccattgtgggcaacgtcacaaaatcccacgatgtgtgcaacctccccaaatcccccacactctgtgcaacctccccaactccccgactctctgcaacctccccaaatcccccacactgtgtgcaaccttctcaaatccccctactgtgtgcaacctcctcaaatcccccccactgtgtgcaacctcctcaaatcccccccactgtgtgcaacctcctcaaatccccccatggggggcaacgtcctcaaatcccccgactgtgtgcaacctcctgaaatcccttcactgcgtgcaacctccccaaatacccccactgtgtgcaacctccgcaaatccccccactgtgtgcaacctccccaaatcccccccactctgtgcgacctccccaaatccccccactatgtgcgacctcctcaaatccccccagtatgtgcaacctcctcaaatccctccactctgtgcaacctcaccctatctttcccactgtgtgcaacccccccaaatacccccactatgtgcaacctcctcaaatccccccactgtgtgcaacctccccaaatccccccactgtgtgcaacctccccaaaaccccccactgtgtgcaacctccccaaatcccccccactgtgagcaacctccccaaatccccacactgtctgcaaccaccccaaatcgcccccactgtgtgcaaccgcctcatattccccccactgtgtggacccttctcaaatcccccctaatgtcagcaacttccctaaatcccccaactgtgttcaacctccccaaatccctcccactgtgtgcagcctccccaaatcctcccgactctgtgcaacctcccaaaattgcccccactgtgttcaacctccccaaatccctcccactgtgagcaacctccccaaatccctcccactgtgtgcagcctccccaaatcctcccgactctgtgcaacctcccaaaattgcccccactgtgtgcaacctcctcaaatccctcccactctgtgcaaactccccaaacccccacactctgtgcaaccgccccatatcccccccactctgtgcaacctccccaaaacacccctcaatgtgtgcaacctcgcccaatcacgacactgtgtgcaatctccccaaatcccgcccactctttgcaacctcgccaaatcccccccactctctgcaacctccccaaatcacccccactctctgtaacctccccaaatcacccccactctctgcaacctccccaaatcacccccactctctgcaacctccccaaatcacccccactctctgcaacctccccaaatccctcacactgtgtgcaacctcctcaaatcaccctactgtgtgcaacctcctcaaatcacccccactgtgtgcaacctcctcaaatccccccactgcgagcaacctcctcaaatctccccactgtgtgcaacctcccaaaatctcccctattgtgtgcaacgtcctcaaatcccctcactgtgtgcaacctccccaaataccccccactgtgtgcaccttcctcaagtcccccactgtgtgcaacccccacaaatccccccactgtgcgcaacctcctctaatcccctcactgtgtgcaacctacacaaatgccccccacagtgcgcaacctcctcaaatcccccaccactgtgagcaacctcctcaaatccccccactgcctgcaacctcctcaaatccccccactgtgtgcaacctcctcaagtcccccactgtgtgcaacccccacaaaactcccactgtgcgcaacctcctctaatcccctgtgtgcaacctccacaaataccccccacagtgcgcaacctcctcaaatcccccaccactgtgagcaacctccccaaatccccccactgtgagtaacctcctgcaattgccccgcactgtgcaacctcctcaaatcccccccacagtgcaaaacctcctcaaaacccccgccactctgagcaacctcctcaaataccccactgtcagcaacctcctcaaatccccccaactgtgtgcgacctccccaaatcccccccacagtgtgcaatctccacaaatccccccccactctgtacaacctccccaaacccccccaactgtgtacaacttcctcacaaccacccactctgtgcaacctccccaaatcccccactgtgagcaaccttcccaaatccccccactgtgtgcaatctccccatatccccccactgtgagcaacctccccaaatcccccacactatgtgcaacctcctcaaatccccccactctgcacaatctccccaaatcccccccactctgcgcaacctcctcaaatacccccagtttgcaacctcccaaaatctccctatgtgcaacctcgcaaaatctcccccactatgtgcaacctcctcaaatccccccactgtgtccagcctccccaaatccctcccactgtgtgcaacctcctctagtcccccactgtgtgcaccccccaaaaatccccccactgtgtgcaacctcctcaaatccccctactgcgagcaacctcctcaaatctctccactgtgtgcaacctccccaaatcccccactgtgtgcaacgtccccaaatccccccactgtgagcaaccttcccaaatccccccactgtgtgcaatctccccatatccccccatatccccccactgtgagcaacctccccaaatcccccacactatgtgcaacctcctcaaatccccccactctgcacaatctccccaaatcccccccactctgcgcaacctcctcaaatccccccactgtgtgcaaccttcccaaatccccccactgtgtgcaacctcctcaaatccccacactgtttgcaacctcctcaaatccccccaaatgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatcccccccactctgtgtgcaacctccccagatctcctttctgtgcaacctccataaatccaaccaaatgtatgcaacctcctcaaatccccaccactctgtgcaacctccccaaatccccatcactctgtgtaatctccccaaatcccccccaatctgtgcaacctccccaaatcccaccactgtgttcaacctccccgaatacccaccactctgtgcaacctccccaaaacgcccccactctgtgcaacctccccaaatccccccaactgtttgcaacctcccaaatcccccccaatgcgagcaacctcccaaatcccccgtgtgcaaccccccaatctcccccactgtgtgcaacctcctcaaatcccccatcactcagagcaaccttctcaaatccccccaatatgagcaacctcctcacatccccctcgctgtgcgcaacctcatcaaattttcccactgtgtgcaacttccctaagtcgtccaactgtgttcaacctccccaaatccctccaactgtgtgcaacctccccaaatccgcccccaccctgtgcagcctcacaaaattacccccagtgcaatctcaaatccctcccactctgtgcaaactccccaaaccccccacgcagtgtgcaacttccccaaatccctcccactctgtgcaacctccccaaatccctaccactctgtgcaacttccccaaatccgcccacactgtgcaaccgcaccaaatcgcgccactgtgtgcaacctccacaaatcccgcccactctgtgcaatgtccccaaataccccccccactctgtgcaacttccaaaaatcccccacacagtgtgcaacctcctcaattccctctagtgtgtgcaacctcctcaaatctcccccactgtgtgcaacctcctcaaatatccccactgtgggtaacctccccaaatcccccccactgtgtgcaacctcaagtcccccactgtgtgtaacccccccaaatcccaccactgtgcacaacctcctctaatctgttcactgtgtgcaacctccccaaatccctccccaatgtgtgcagtctcctcaaatcctccgccactgtgagcaacctcctcaaatccccccagtgtgtgcaatttccctaaatcgccgcaagtgtgtacaacctccccaaatcccccccactgtgtgcaacctccccaaatctcccccactctgtgcaccttccccaaatctacctaactctgtgtaacctcctcacatccccccactctgtgcaacctccccaaatcccccccccccccattgtgggcaaccacaccaaatcccgccacttgtgcaacctcatcaatttccccccattctgtgcaacctccccaaatccaccccactctgtgcaacctcccaaaatcccccatactgtatgcaacctcctcaaatccctgtactgtgtgcaacctcctcaaatcccccccactgtatgcaacctactcaaatccccccactgtgtgcaacctcctcaaatctccccactgtgagcaacctccccaaatccccctactgtgtgcaacctccccaaatcccccccactctgtgcaacctccccaaatcagccccactccgtgcaacctccgcctatccctcccactgggtgcaacctccccaaatccccgtgtgccacttccccaaatcaccacattgtgagcaacctccccaaatccccccactgcgaagacctcctcaaattgccccgcagtgtacaacctcctcaaatcctccctcgctgtgtgcaacctcctcaaatccccccactctgtgcaacctccccacatgcccccagtgtgtgcaacctcccgaaatccacccagtgtgtgcaacctccccaaatccccccactctgtgcaacctcccgaaatccccccaactctgtgcaacctccgccatccctcccactgtgtgcaacctgctcaaatccccaaactgtgtgcaacctccccgaatccccccaactttgtgcaacctcaagtccccgaatgtgtgcaacccccccaaatcccgtgtgcaacctccccaaatcccccacactatgtgcaacctcctcaaatccccccactctgcacaatctccccaaatcccccccactctgcgcaacctcctcaaatccccccactgtgtgcaacctcctcaaatccccccactgtgtgcaaccttcccaaatccccccactgtgtgcaaccttcccaaatccccccattatgtgcaacctccccaaatcccccaatctatgcaacctccccgttccccccaatgtgttcaagccccccaaatccccccactgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatccccccccccactgtgtgcaacctccccagatctcctttctgtgcaacctccataaatccaaccaaatgtatgcaacctcctcaaatccccaccactctgtgcaacctccccaaatccccatcactctgtgtaatctccccaaatcccccgcaatctgtgcaacctccccaaatcccccccactgtgtgcaacctccccaaatcccgccactgtgttcaacctccccgaatacccaccactctgtgcaacctccccaaatcccaactgtttgcaacctcccaaatcccccccaatgtgagcaacctctcaaatccccctgtgtgcaaccccccaatctcccccactgtgtgcaacctcaaatccccccactgtgtgcaacgtcctcaaatacccccactgtgtgcaacctccccaaatccctgccactgtgtgcaacctcaccaaatccgtccactgtgtgcaacctccctagatcccccctatgtgcaacctccgcaaatacccccactctgtgcaagtgccccctatttccccaactgtgtagcaacctccccaaatccccccactgtgtgccacctccccaaatcccccaactgtttcgaaccacctcaaatccccccactgtgtgcaacctccccaaatcccccccaccctctgcaacgtccccaaacctactctgtccaacctccccaaatcctccactctgttcgacctccgcctatcgccctactgtgtgcaactccctcaaatccccccactgtgagcaacctccccaaaccctcccattgtgtgcaaactcccaaatctccccactgtgtgcaacctcctcaaattcttccactctgtgcagcctccccaaatccccccaactctgtgcaacctccgcctatcccccccagtgtgcaacctcctgaaatcccccaactgtgttcaacacccccaaatccccccattgtgtgcaaactcctcaaatcaccccgctgtgtgcaacatccccagatcccccccaatgtgtgcaacctccgcaaatccccctactctgtggaacctcctcaaatcccaactgtgagcgacctccccaaatcccccaactgtctgcaaactccccacatctccctcactgagtacaacctccccaaatccccccattgtgagcaatgtccccaaatccccccactgtgagcaacctcctcaaatccccccactgtgtgcaatctcaaatcccccccactgtgtgcaacctcctcaaatccccaccactctgtgcaacctgcccaatttcccccactctgcaacctcccgaaatcccccgtagtgtgtgcaaccttctcaaatccccccactctgtgcaacccccccaaatccctctactgtgtgccacctcaagtccccccactgtgtgcaacctcctcaaatcccccacactgtgtgcagcctcctcaaatcctccccactgtgtgcaacctcctcaaatccccgcactgtgttcaaccttctcaaataccccatactgtgtacaacctcctcaaatcccccctgcagggagtggcttctccctgtgaatctctcctcccttctttgcccagaagcatgtctcaattagtaagagtgcagttaatatttctcatcttaaggtggtgctccgacctgatacaaaggaaagcgggttgaattcagaggcacgggcataccctgtccttgtttctaaagtgttcatgaagaagatcgaattcaaatggtgaaatatccatatatgcaattgtatagaaaagtcaggattatttgacaaggattgtttttgatgcttttatgcaattcagaacctcaatgaatatagaaaataatttaaaaagacataagagctctctagattgaaataagcatggtgcttataaaacaatggtgaacagtgaatgccaattattttaatttaaatttctattatgcagcaaattcataaaatggggaaagtcttttttcaacatttccaagacatgctctgttaagacatggttgcttcaggtggcttttacttgggatattgagaggtaaggcagagtggtgatggttcaggctgaggagggcgagggctgccataacaaagaaccacacgtttggtggcttaaagcaacagacgttgatgttctcacagttctggagaccagaagagcaagtcacggtgttggcagggctttgctccccccgaaggttggaaggacgaatgcgccttgcacatccagcctttggtgccctgctggtgttcactggcattgcttggcctacagactcctcacgccaacctctccctctgtctttacccggccttctcccctgcgtgtctgtattcaaatgcccctattcctataagggcaccagtcctgctggattccaggttccaccctaccccagtatagactcaccctaactaattacatctgaaaaaaaccttacttccaggcaaggtaacattcccaagttctgggtggatgtgactttgaaatgattatcaagtagatccagttccgtttacagtaatgagcagacagtgaatgagaaattaatgtgctttcacatcgcacgaacacctgaccttcactgaattttaatagaagctggcattggtgctaactccttacagactttatgtcagtgtattctcactgaaggaagttgctattttatcccactttacgaatgagaaaactgagatgcggagaggtcaccaagtcaaactcaagcgacaccccagcccccctcggtgatcaggctgaagcgatgactaaatgccatttgctcctaatgacaccgtcacaagcactgaagccaccaaggaccgttgggcctgtacagaggagaggcagactcaggccctccccactgacaggagggctgtcttccatgtacacctaggtcggagtccgcaagggtggggcggtgacggtgcactggactttgctggcggtgctggaatggctatgcggagggcgctgtggtgcggggactgcgctccccaggaggacctcgggagttgtttgtttgtaggtattacagtattgtctaacgttgccgcgttgacacagggtcacgggaagccacctccagggcctgtggtcctcttcaggcaggcggggcggggaatgctcaggaccggtgatgatggtgccatgcagagttcagggatgaatgaccaccaaggcaagggaaggagtccagcagctcagtatttggggaatgggggcgggggcaggtaaaaacgcagaatcaagggaaacaaacagctggaaaatatagtagctgttaagttctgatggaaaagctgttttgtacttacagttaaatcccacagtatttgtgatgtatttccgggtaacttgctcttccctcctcaaaaggtcccagcctcaccagagcttcccttcctgcaccggccccagctctccacgcctcccagagaccagggggcctccacccttgctcctctgggacggcgcttcctccccctcatctccaggtcggggctggggtcttcaggctcaggttgaagatgctgttgggccctttgcctgtacagggatggcgcccgacccaggaaaagcctaacgttgtctgtcatttggatgcgtctcttggcagtgactggggggaaatcctcactgcagcccgcgtcccttgcatgattgttgtaagaaagccccagctcagctgcgtggagacagggtcctcttggctgcaaattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtggggaggtgctggtcacaggcacaaagtctcaggcaggaggagggcgcctcaggtctgctgcacggcatggggcgcacgcttcctcataatgatcgcatgtttcaaaattgctaaaacaataggtttttttttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 1357 - DNA, 128321 bp, Homo sapiens; identical to SEQ ID NO: 1356

SEQ ID NO: 1358 - DNA, 129268 bp, Homo sapiens
tggaaggcaattaaggcgcccatttcagaagagttacagccgtgaaaattactcagcagtgcagttggctgagaagaggaaaaaaggtcaggttgtaaagctttttatttttccattttctaagagaaattcatcattggaacttgtaaagtggcccaagagtggctgtaatttgggccattatagcaggtatgggtggcgtctctcagcaaagctgactgactgactgatgagtgctgtttgcaatgacctccgctggaacatgtgagtcctgtagggtcgattcctagatcaccgtctactgagacacattcctgtcagcatggactcactggtgctatcctgcttaacaaaattagtggctcaaaaatagccacagaaagcctaagagaagaaaacaaggatttgaaagtagaaatgatgaattttgaatcttctgttttgtcttaacaactagaattctaaaatcattttatggacataagaatgctttaagaaattcaataggcatttaggggttttatttatcacttttataaagactaaatttctaatagtactcactttttgccacatagatgcattaggggaaacagatttttttcattcccaataattattcccagtactgttacactatttgacattaccaaaaatttaaataggttattactgagatatattggcaactggagctgccaacataaaaactctgtttttgaataatgggggcctgggaggcctgctcagcgctgcagtttctgtaacctcctgacatggacggcgactctggtctcgcagaccccaggcctgtgagggtcgctcactgcggtagaggctgcgtggagtcagtggagggagcccctcagcagggagacaaggacacagcggttcccatggccttgtcagtgcttgattacatactctgtctccttccgttaattttagaatgagagcgctcgctgtgctgtctgtcacgctggttatggcctgcacagaagccttcttccccttcatctcgagagggaaagaactcctttggggtaagtagcaaacacattgcggtcttctggccttataaagttatttttcacacttactaaaatagagggcataatggtagctcctgagagtcactttaggcccctgtagtgtatgctttgttatgcttaagaaaaaaaaattgtaattcttgattttagaaggattgaaatatgtacatttctttctttaaaaaagagctgattttccttggatgacacaatagacaattttcacttttacctattcatataactgaaaaaaaaattctttgggagtgtttttcttcctttgctacagaattattttttattaaataacttctgtgatgtattttctggaatcagtgtgctactatgtgaaaacaagttaagaaagctactgagatgcagtggttaaaataatcacagatcaagctctttgcttttcttttaataaaataaataaagttccaaaccctgagaacaagtttcactggagtgaatactgcaggggcatttgcctggacattttaccccatggacaccgctggccccgggagcaggtgacacctcgctgggcaggtccctgggcctctgcacacagtcccggggcccctggagcaggtgacacctcgccgggcaggtccctgggcctctggacacagtcccagggcccctggagcaggtgacacctcgccgggcaggtccctgggcctctgcacacagtcccggggcccctggagcaggtgacacctcaccgggcaggtccctgggcctctggacacagtcccggggcccctggagcaggtgacacctcactgggcaggtccctgggcctctgcacacagtcccggggcccctggagcaggtgacacttcgccgggcaggtccctgggcctctggacacagtctcggggcccctggagcaggtgacagctcaccgggcaggtccctgggcctctgcacacagtcccggggcccctggagcaggtgacacctcgctgggcaggtccctgggcctctgcacatagtcccggggcccctggagcaggtgacaccttgccgggcaggtccctgggtctctggacacagtcttggggcccctggagcaggtgacacctcactgggcaggtccctgggcctctgcacatagtcccggagcccctggagcaggtgacaccttgccgggcaggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgcccgctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatgctagatgttcagccaatggtttgtaaattaattactttgttattttatttcatatttagtaggacctggttgtataaaaccagagtaaaacatgttagaagtcaagagctagttctgagcaagttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatgagttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcacccttatgtgtcaggcacccattttatagatcaaaacgtagaggtctggaagtctcagaagcagcaaggctgtggccgctcagtctcacagtctcacgtcccaggtctttacagagaaccaacacacatcctcatacttgaagctcgatgataagtactcagcgaaaagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcagtcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtattaggccagtgccgtgactcacatctgcaatcccaacacagtatcaggccagtgccatgactcacatctgcaatcccaacactttgggaggccgaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaaaagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaacacacaactctaaacaggaatcaagcgcttagaattaggagcaaagctctggccctgggggcttatggttttggagaagaaagattttggctttcatatatatatttaacataaacagcctttggaacaaggcaacttccttcttctttctgaaatgtggtatgttcttgcctaatgtgtccctgaattccacctcttttatgaacaatatgaatatgcataaaggagaatttgggggaaccgtgccatgcgcccctcagagcaggagcaatcttgagaaggcgcaggcagagagcagcgggcggcttctccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccgcaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaatgattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttgagactatctgatgagagttatgtgtctctgggaggaagttttcaatacagaaatggatttattttatgaaacttaaaagactaataatctgcaagcctataagaatgttttaattctgtaaaatattttacaataagaaaagaaactagagactaagcaacatatgatcagttaaacttgaataacaatatattaatattggtcaataacaaggaatgatctctctagtaactgccgtttccaagcatagtagagaaggataagcatgtttctttatatttaatcagttggttcttaaataattgtcaagtgcctgctgaaaaccagcctttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagccttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaacacccctcaacagggaacagaggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggaggttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgccccagggagccccacaccggggggctctgttcattgctctctgcccaaccctgaggggtcaccctctgccccaagtgcttaaccactggttactcatcccagaacccaagagagatccagcacggaggttttcttaactttgctgtatcacactgtaagaaactgggtggccaatggaacagacggagcagggcagagtgagcaggaagaaatgatgctggggaatttgtgtgctccttgggtggggacgagcatggaaggcgcgtgggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacggtgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagcggggaagtgaaggcctgtggagggaagcgaccccgggacctggctgcctgcctgtcccggaagccacgtgggcatcaccgcagcaagatgggcttgaggaacaaagcaacactgtcagtgaatcgctgaactgtcattgcgctttgactgtgtgacattctgttccgtaggaaagcctgaggagtctcgtgtctctagcgtcttggaggaaagcaagcgcctggtggacaccgccatgtacgccacgatgcagaggtgagccttgcggaggggccgccgccccaaatgccaccgacaggcgcatcctccctgacatccacacacgtgtggcctgattttcgcaattgcagatgaaaacctgaagcttgccattgttaatttacttccccagtgtcatgtgcaagcagcagacagaactggtatttaatctccaatcctttcttaagcaagacacaaaggaggagcaccctgatgcaattagcaattacgtataccctggttaaaagacagtagaggctgacgtcctgatagcaaaaccagcctctcttctccaggattaggacagattaaggaggaaaagagagacctagatcccagatctttggtgttgtgatataactgtaacattacctgtggcatagaataaagaattaaatggggctctcccccatttttgaaataattagcatttgtaattatataacagacaccactattaagaatattgtggtctcatattacctgtctagaaaaagaaaagaaaaacaaaaaacaaaaaacctgtaaagcagtttgccctcccaagcttattattttgtaggaagttgactaataattatataagttcttgagatacaaaatatcaaaagacagcagttaatttattccaaatttctattattccagccagaaaaataccttactgttcatattggctgcaaacaaattattatttattttctaaaaattgaatcaaagggaaaagaaagagaaacactatttctcataaactcacgcacactttaatatgtctaaaatgggcaggaattcctggggaagacatggcagtgggggtggataccaagtgcgtagtaagaagtgtgtgctgctctcttagtaacaatttgtgaacccaagtatctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgagcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatcaactggggagactattggaaagatttgccttttgatagctctcaaaaaaatacactatactatacacctattccaactatgtttctttccttaagaaatactgtttctactgtggaacagtcattgttctagatgccgggatacagagatgagttcgatcatttcatatcctcagaagtccgtgctccttctgtaaagtcattgttctagatgccgggatacagagatgcgttagatcatttcatatcctcagaagtctatgctccttctgtaaagtcatttttctagatgttgggatacagagatgagtttgatcatttcatatcctcagaagtccatgctccctctataaagtcattgttctagatgccgggatacagagatgagtttgatcatttcatatcctcagaagtccgtgccccttctgtaaagtcattgttctggatgctgggatacagagatgagtttgattatttcatatcctcaaaagtctgagctccttctatgcagtcattgttctagatgccgggatacagagatgagttagattatttcatattctcagaagtccatgctccttctgtaaagtcatgttctagatgccaggatacagagatgagttcgatcatttcatattctcagaagtctatgctcctcctgtaaactcattgttctagatgccgggatacagagatgagttagatcatttcatattctcagaagtccatgcccgttctgtgcagtcatttttctagatgtcgggatacagagatgcgttagatcatttcatattctcagaagtccgtgccccttctgtaaagtcattgttctagataccgggatacagagatgcgttagatcatttcatatcctcagaagtccgtactccttctgtaaagtcatcgttctagatgccgggatacagagatgagtttgatcatttcatatcctcaaaagtctgagctccttctatgcagtcattgttctagatgccaggatacagagatgcattagatcatttcatatcctcagaagtctatgctccttctgtaaagtcattgttctagatgctgggatacagagatgagttatatcattttctatcctcagaagtctgtactccttctgtaaagtcattgttctagatgccgggatacagagatgcgttagatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctataaagtcattgttctagatgccaggatacagagatgagttcgatcatttcatattctcagaagtccgtgctccttccataaagtcatttttctagatgccgggatacagagatgagtttgatcatttcatatcctcagaagtccatgcttcttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttgttggttggagaactgacttactttgagtaaaagttttaataataataaaatacttttatccttcaaaacacatctagttactttagagccgaaaaggaaaaaaaataacttttctaaataataatatccaaaactagagtgtgcctaaatcatttcttccactcactcatggacagtggtatggccctaggcttttggaaagtgataggaaagcacagagcctgcctacggaagtgtttacgaaaagggagagtctgagaccaccctaccccctcattcatcacttcacttacctggatagcatggggccagggacaaagggactttgctcccaaggtagatggggccagagttttagtgtttacgctcattccctgagaccagctcccatagagcaatggaaaggagaccagggcaggctgcacacagaaggggccacatctggggaggggggccctgtgcctggggacccagatctttatgatgtgcagtgagcttgccggcccaggctctggggaagagcatccctgtttgactggagagtgcagtgtgttctgaaggaagatatgatgtccagggaggcaggggagggttctggggcctgcggcccaggctgcatcagcaaccaggttcacctgcagcagccagaccctgtgagggaggcaggcattgtgtctgggccacctggccaggtgtggctggtagtgagtggccccatgagtgtgtgggggtgagggtgagtgtgcccttgacctggcaggcacccctcggacagggcagtgtgcttttctcccaccatggcaaagagcgggcactgcagatctgctccctccacctgccgtgagagtgggagcaactgtctccctttctccgcttcataattttataatttcggcatggacagaagaagcgtctgcatgaggaggctgtgggtccgggagaccagaggccgaggaaccaaatgctcccatcagtctcagttgctcaccccatgatctgtctgggctcacactccttgagcagtaaattcattcccttttagcattcagggaccatttccaatattcacaatttgctgtgagttccagggtgtattcagcctggaatatctgcatctagattggtgataccatttgagtctgtttactgttcacggtgaaacactctgggcattactgggatgacagacagaagagctaaaggagtgttattatttaatcaaatgaagctattggatgatgtccccaaaccgagagcgatccagagaattcgtgggaacatacatttgatgcatggctctgtgtgggctcttcacattaagaatgcgaaaccagctagagtcaaagtttccctaatttgagtttgattttcagatattttgctgcaattaagagcctgaaagtgtcacctattaataccttgcttatgttctgaagctgaggtcttaaagtaacatgcagccctgggctgggctgcaaactgtctgcattcggaatgacccatggctggggcccctgggaaatagcagcagatgaacagagcagactgtggcttgtggggtggttgaagcacctttccaggctctcctgaactgagctccccacaggctgggctctgcagaacatggacatgacgggaaagtgaccagccagcaagggagagtcctctgagctacacggcagttgcagggacaggaagggctggcatgggcagcatggcctggggacctatccgggggatccactgggtgataccctccacgtcactgtcaagagctgagctcagtttcccagacccctgctttcctgacgtaccccttttgggcccagattgtgttgtcccatgggtgccaggcaaaagaagggatgagacaggtgagccctcgagtgggtgcaggtgatgttctaggaagcagagaaagtggatttcatcaaaaggagcacccttggccttcagatctccagagaattcttgttcttcctattagccaaatgtcttgctcagatagattttagataaatgtctccaaggaaagcacgcgttttggggagggttgctatcctgtctaccatggcgagtcctggggaacctgcacaggtgcttacactctggctctgctgctgctgtgactgacaatgtcacttgtgtctgggccgagagtctcctgtctttggctggcatccatgaactatggctggctaatgtgttagttgtaagtagctataatctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagtgaaggccaggctgacatggtctcagatggaaatgaggaacttactgggaactggaggtagaggccgcctgtgctatgcctcagcaaagagcttggctgcattgtgtccaagtcgtgggcatctatggaaatttgaacttacgagtgatgacttggagtatctggcagaagaaatttctatgcagcaaagaattcaaggggtggtctggcttcttctaacaaccaaccatcagatatgagagcaaagaaatgatttgtatttggaaattatatttaaaagggaagcagagcataaacatttggaaaatttgcaggctagccacttgatagaaaacaatatcctgttttcagggaaagaattaaagggggttgttggagtaaccatttactagagagattagcatgactaaaagggagccaagtgctactatccaagacaacaggaaaagggcctcgaagaaagcatggtataagtcctcaggacagcccttactgtaacaaggccagagatctaggaggaaagaatgacttcagagtctagaccttgggcctctttgtcctgtgcagcccagggacactgatccctgtatcccagctactctggctctgggcttggctcagaggggcccaggtactactcaagccacagcttgaacagtccaagccgtaagtgtctatagctttcacacggtgttcagccttcaggctcacagaatgcaggagttaaggaggcttagtagcttcccctagatttcagagaatccatgaaaaagcctagtgcccaggtagaagcctacttcaggggcaaagccctctcagaatgactctactagggccatgctgagggggaatgtgaggttgaagcccccacacagagtgcccactgagacactgcttaatggagctgtgggaagggggccatcgccctgcagaccccagaattgtagatccaccagcagcttgcactctgcaactgaaaaagcctcaagtgctcaactccaacccatgagagcagccaggtgggctgtgttcagggaagccacaggggcagagctgcccaaggctatgggagcccattcctcacaccagggtacaggacacggagtcaaaggagattgtttcagagctttaagatttaatgaattgcctgctgagtgtagactggtgtggggcctatcaagccttcctgttggctgatttctcccttttagaatggaaaaatatacccaatgctggtgcccccattgtatcttggaaacatataactgcttttttatctcagaggctcataggtagaaggacctcatctccagatgagactttggacttgggattttgagttaatgccagaataaattaagactttgggggactgttgcgaatgcgcaattgtattttggaatgtgagaaaggtgtgggatttgggggaacgggtagaataataaggtgtagatgcttttcccccttaaatctcatgttaaaatgtgattctggatgttggaggtgaggcctggtgagaggcgattggatcacaagggcaaatccctgatgaatggtttagccccatcctcttggtgatgagtcagttcttgcccaggaagtccatgtgagacctggttgttttacgttgtgtggcacctgcccgcttgacctcttgctccttctctcaccatgtgagacacctgctcctgctgcaccttccaccatgactgtggcttcctgaggtctccccagaagccaagcagatcctgggtccatgtttgcacagcccgcagaaccttgagccaattaaatcccttttccttatgaattacccattctcaggtatttctttacagcaatgcaaaaaataggttaacaagtaagctttttaaaaatttatttttattgtatgtatttccgatgtgcaaaatgatgttttgatatacaaatacataatgaaatgatcactaccgtcaaacaaagttaacatacccatcaccttccgtagtgattggtgtgtacatgtggtgagagcacttaaaatctctcttagcacattagtttttagtattcaatattattaactacggaaggaatacaagtgcttagcacagcacctaaaactttattttcactcagtaagcactatgtattttggggttattattaataaacaaaaatataaacaatgcatttaattatggcagaacaactgaagagaacaactaggtcacttttcccaaagccacagtaggtgattctgagccctgagcctcatgtctaacttgcagagggaaggaggttctcctgccagctctgtagttctgtctggcgtctgacactcgcacacctgccaacacctccccaactctactctcttgctcctgctcttgctctaggacctgtccactcacacacctgccgtggtcacttgggcagtgctggcctcctgtcagctggagaggccccgccctgcaggcgactcagccagggcagctgtctggagcccccagagcacagtccgctgtggtcactctgcttcttctttgaggcctggccctgccagctttgctgccaaaggtgattgactcaacattcagacaagaaggatggtgaacttgatgtagtcctcccttgggtcctggggactcagtaattccattctgcaggtgcctggacaatgctctgatccacccaggtgttggcagcattgttgcaaaggtcacctctgtgctttctctccaggttccccaggtcctcaaatgctagtaggcaagccagttgtgaaaccttggattggttccgtgtagctgctgctgctgagaatctaaaaaggccaggtgcttgtgtgggagaccaggagtaaggggaggcctgcaggtgaggggaggccccaggtgtggagaggcctgcaggtgaggggaggcctgcaggtgaggagaggcctgcaggtggggtgaggcctgcaggtgaggagaggcctgcaggtggggtgaggcctgcaggtgaggggaggcctgcaggtgaggggaggcctgcaggtgaggagaggcctgcaggtggggtgaggcctgcaggtggggtgaggcctgcaggtgaggtgaggccccaggtaaggagaggcctgcaggtgaggggaggcctgcaggtgaggagaggcctgcaggtgaggggaggcatgcaggtggggtgaggcctgcaggtgaggagaggcctgcaggtgaggagaggcctgcaggtgaggggaggccccagatgaggagaggcattcagatgaggcaggcttcacatatttcttattctatgagggtgtgtttagctctcactgtgaacagctttgctgccccgttctagggctgcattgagccaatgctctgcactggagtgggaagggaagaagttggagctgggacacatgcagcttctgcaggctttggctctgagatcagggcagggctgtgcgcttcccagtctcctgtttcattagctgggatgtaaacaaatcatatcttggtttggatgtgatggcctgtccgcaattgttatgagaatccaattcattctgatttggcagttttgtaaagggcaagtctgtgccattttcctcatcattcaatactgatgcatcacttacaccctattcctgttcctaaacccagtgaccccgtggacagcaactgcacatgttttacctgtgcacaccccgcagtgcctgtcacattgtctgggacacagtagttactcaataaatgtctgcttaattaattagtaattaagtaccaaagataccatagacaaataatctattttatatcttctttatgtgccatagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacgggtaatgtgtgcccctctccccactgaggagcggcaactcccgaaggaggacaccttgactttgtgcaggggctgcttgctcagggcatgttttttacttgagaccaagcaggatgggactccagctctttcaaagcatacaagctgcaatttttaaaaatgcttaccaaacagtctcaatatcttatttttgttactctggaaaatagccatttctctcctatccaaatcaaatttgagaagtagctcaataagctaaacatccattttttatggtataaaataatttaggaattttcccatagcccccctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcattcaaaagtcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggctgaacgatgtttctaagaactctcggtccactgtcctgttacgggacactgtcctgtccactgtcctgtcaggcctcctatggaaatggcagttcctgacgtcagaagatgtgggtctttctggtccatgccttagagccacatgctcactgccgggtctgtagacatcgatgtttaggagaataggctgaggtatttggtccaggctataatgtagaacttaagaactccataatttagaattttttaaaatgatttccgttgtaagtatagcccatcttgaaaatttagaacacgaggaacctaaaaaggtttcccattacttcatcaccaagacagaattccattaaaggtcagtgcctgtccttctaggctgctccttcatgttggtcttgtgtgttacatgactatgacctcatagttcttttcttctttttttttgttgagatgaagtctccctctgtcgcccaggctggagtgcagtggggcgatctcggctcactgcaagctccgcctcccaggttcacgccattctcctgcctcagcctcctgagtaactgggactacaggcactcaccaccacacccggctaattttttgtatttttagtagagacggggtttcaccatgttagccaggatggtctcgatctcctgacctcgtaatccaccctctttggcctcccaaagtgctgggattacaggcgtgagccaccgtacccggccaatggttcttttctatcgcacatgatttgttgtctgcaagcacctgcttgagggcattcctgtcaagaagaatctgtgctcagctttttgaagaatgcgtaatcctccactaactgaatgcacactgcagtccaaggtttacttaactgttcccatagagccattcccgttggactgttagtgagcattcatgattgaaagactagtttgtttctctcatatctgaaaatggaatgcattccttcctggcttttttttcttttgaatatctcaatttcactggtatcttgttaatcaaagttttgtggcattatcctcaaagatttatataaaccatattggagaagtaatcgatgattacctctactaatggacaataaagccactctcaccttgatttgttgaataacatataaattatagtgacagaattaatccaaaaaaaagaaaaacaggaaattgtttcctgggttctcgtctcatctggaaagatttacaagggaaccaaaaatcaatacaaaggaaaaacgaaaggttttatagataagcgtaccatcttcatcaaggcaagattttttctacattagggttcgggataaattctactcctcactgtcttctaaagcactggggccattactaggcacacatgcctcactgttcgaatatgatgaatgagccctggagatgtgcttagtgagagttgatggtaactgcaaagttacttgctggcttatccccctgagggctgagagctcctagattgcttttctgaaagatcacagagcaaaaataaattttaaaacccccacatttctagcaataaggaagctcaagggaattaaatgagtgagcacttgatgtaaagggagaaggcagattttctcaaaaacagtgaccccagttacatatgaatcccaaattcagatgctggagtcacttttgagactgcaatagaatatttgttaggtggatttgtggttacaagcacagaattcatggtttcctatttttcacagatgctttatcagaagatctgctgagcatcattgcaaacatgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagccacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccctgttatggccaacaccatctcagcaccctccttctcaactcctccctcagtccccactgcactcagagtgagttcagatccgcccaacagtggtgactgcccacctcctctggtccacaatggcaggagatggacaggagctttggccacacacagaggcatgtgattcagtctggggttcagaatggttttctgaagaaggtgatatgcgagtgagccaaatcttaaaggatgagtgggcatttctcaaatggtccacagggtagagaagagggctttgcaaaggccggaaagagcaagatgcgtttgggctgaaacgtgcagcctttggcacacagaggggcagagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagccatgacccagacctcaggtgcattctgatggctctccctacggaggtcgacccaggggccaccccccacccacccccaccctgccccacgtccctcctccacgtcagggggatgatgaattcagccatgtgcaacatcgtgggcatccttaaagcaaattgcagtggagggtgaattacagtgcttggggaatccctgagcaaagccagtaggcctcacacatgatctaaatcttgcttgatttgcaaacagaagagaaacttaactggagatttttttttttttttttgcaaatgcctggattaaagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttattttttctctgcaggcctgttagtgccaaagcccaccaagaccaagctcaaatttactcatgcccaattgtgataaaaatagcccaaacaagcagacttttagccacttggagcctacctctttgcatcttccacaaaacctctcccagcatctcaggccgttggtaagatacagcctcgtggtcatcagaccccaggtcgctgctgtctctggagttgcctgcccagagactccccctctccccctcaccatgttgctgagtaatgtcaccagacatggagaccctctgatgccccactgtgagttcctcgccatcctccccatctgggtggcggtccctcaccttagcctctggatggtcccctgccttgagggatgtcccctcttctgcacctgtgcccaagaaccaccccaaaggcatgtgtgtgtctctgcctccccgatcctaacttttgccttgctcagccctgagttcccagagcttccccacacccactaaattgctaagttcccccccagcggtctcctaagccgcttcggcgtccctctcagtcaccagcacctggttccccacccacaccttcccatccttgtctgggctggtgctgcatttccaatgtgctgcgtttccactgtgctgcgtttccaatgtgctacatttccactgtgctgcgtttccaatgtgctgcgtttccaccgtgctgcgtttccaccgtgctgcatttcctgcattccaaagcgacctttgggtgttggctgcaatgacatctttaagacaaatgttagttggaattaacttttgaaattctaaatgtcgaaatggtggattttaaaactcatccatttctactagttttcttgctttatggtgtgatgtctgcatgtcacaagtggatggcagggtttctaaggcttgtttttcctttgttggtattttcctaattgcctaggacgtatcacataaaattacttaacaagtagtggaaaagaatgatttttctttcaccatttcacctggacattttgtttgtatggtgtagtcggtgccgcaggagctaccttgttgaaagagaagggggcaggctgcttctcctttgtgtggtgtagctaatgccacacctgtacttcttgtttgtatgaagtggtcagtgccacaggagctaccactttagaagggaatggagcaggctgcttcttgtttatatggtgtagtcagtgccgcaggaggcactatgttggaagagaatgggcaggcttcttcctgtttgtatgatctagtcagtgccgcaggacgtactatgttgtaagtgaatggagcaggctcattcctgtttttatggtgtagtcattgccgcaggaggtactacgttggaagcaagtagggcagggtccttcttgtttccatggtgtagtcagtgccgcaggaggcactacgttggaagggaacagggcagggtccttcttgtttgtatgatctagtcattgccacaggaggcactatgttggaagggaatagggcagggtccttcttgtttccatggtgtagtcagtgccacaggaggcactatgttggaagggaacagggcagggtccttcttgtttgtatgatctagtcattgctgcaggagctaccagttgtaaatgaatggagcaggctccttcctgtttgcatggtgtagtgagtgccgcaggaggcagtacgttggaagggaatagggcagggtccttcttgtttgtgtggtgtagtcagtgccgcaggagctaccgtgttggaagggaatggggcagactccttcttgttggtacggtgtggccaatgctgcaggacgtaccatgttggaagagaatggggcttgagtttgttttgctttacactttgtcataaaggaaattatcagttctctgcataagcccctattttttaacaagggggtgtgtgtgcatgcacggcaagctggtccctttaaacattttagaatctctaaatataaagcttaagatattaggaatgctgttgataactgtgcatttggggtgaaggtgttttggtagtatcatttaaaggatttccagcttctttctgtttctgttaccaacctgtggagacctcttcatcatcctggactcagatcagggtcctcgactctgctgcgctcccagccagctgaggctgttgttcctcacctgtgtgtttttatagaagtctaggagctggggggtaggaggtgggtgtgggcaggggtcacgtcacttgcaggttgcctttgctagaagcagtcacattggctgagaacagaatccccagggcctgaggatgtcctgcagaaatttgggttttagtgtgtagcttggcatcagcctagagataagacaaattctattttaaaaatcaagtgctccatggcgggatggtgatatagttggctgtgtccccacccaaatctcatttgaattcccacatgttgtgggagggaccaggtgggaggtaattgaatcatgggggcaggtctttcttgtgatgttctcgtgatagtgaataagtctcacgagatttgacagctttataaggggaagttcccctgcacaagctctctttctgcctgccgccatccatgtaagacatgacctgctcctccttgccttccaccatgattgtgaggcctccacgtggaatcgtaagtccattaaacctccttttcttctcagactcaggtatgtctttatcagcagcatgaaaacagactaatacagatggagtaggggagggctactgaagaaatgaagcctctcagctactggaaatagatgcaatcagggtggaattactcacggacagtcctccagaggcagtggggtcattgtggagatctgtgtgccacaacagccagaaaacaaaggggccacgagccactgtttgctctgtggtctaaatcaatggactatcttaccacatgcaatgttagacagtgtattacatatgattattcataagcagaaatacaaatatatattatatactgtaagacagtattcattatatgataaatatgatgaattcacctagatacttcatatagaatttgccttcagttttagattgatacatgtgataagaacttctctgtgtgttcttgagaaagtgctcacattcccatgcataatggaaaggacattgtattttgaaatagaagacgaaattccagccaccactttgtcagttacaagctgcttagacttcatgtcttgcttagtttctcaaattctctgcacctggaaactggcaaagatagtgatgctcatttctagggttgtcatgaggctgaagtgagacaatgcagcagaaataatttgtgagcaataatgatacaaaggtcagtgattgattatgtaaataatggccacctttgaagcccctttcttcaaagagtctgagtcttgattcttgaagaggtgtgatttttctttgaaaaattgcattatttcttgctgggcactttggctcacgcctgtaaagacagcactttcggaggctgaggtcgggggatcgcttgagcccaggagctcaagaccagcctgggcaacaaagcaatacctcatctctaaaacaaacaaacaaaaaattgtgttatttcttgagttttgatctgatgaactactgcagtaaaccactgtgtctcacagtgttggaagggaatggagccagctccttcttgttgtatggtgtaggcaatgccgcaggaggtaccgtgtttgaagggaatggggcaggctccttcttgtttgtatgatccagtcattgctgcaggaggcaccgtgttggaagggagtggggcaggctccttcttgtttgtatgacccagtcattgctgcagaaggtaccatgttggaagggaatggggcaggctccttcttgtttgtatgatccagtcattgttgcaggaggcaccgtgttggaagggaatgggcaggctccttcttgtttgtatgatccagtcattgttgcaggaggcaacatgttggaagggaatggggccggggccttcttgtttgtatgatccagtcattgctgcaggaggcaccatgttggaagggaaagggcaggctccttcttgtttgtatgatccagtcattgctgcaggaggtaccatgttggaagggaacggggcaggctcgttcttgtttgtatgatccagtcactgctgcaggaggcaccttgttggaagggaatggagctggctccttcttgtttgtatgatccagtcattgctgcgggaggcaccatgttggaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccatgttggaagggaatggagctggctccttcttgtttgtatgatccagtcattgctgcgggaggcaccatgttagaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccgtgttggaagggaatggagctggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatggggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatgggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggggcaggctccttgtttgtatgatccagtcattgctgcaggaggtaccgtgttggaagggaatgggcaggctccttcttgtttgtatgatccagtcattgctgcaggaggtaccatgttggaagggaatggggtaggctccttcttgtttgtatgaaccactcattgctgcaggaggtaccatgttggaagggaatggggcaggctccttcctgtttgtatgatccagtcactgctgcaggaggcaccgtgttggaagggaatggggcaggctccttcctgtttgtatgatcccgtcattgctgcaggaggtaccatgttggatatggtaccatgttggataagtggcacagtggatagaatccatcgccatagtgaccatgagtggattcctgctattaaattggggtacgacttatgcagggcttgggggtgaatctggagggacaggtggccgagtcttccatgggcctgcacccccagatgagaagcccccaggtgcagatcgagaactgtacaccccagagggctgccttctggcccctcctaggttttgacatctacccagaggtgaccattgctttgatcttcatcaccatagttagttttccctgacctggcttttataggaaggaagttagatggtaacccctgggcctggcttctccacctccaggatttatttgctcctgccttgctgagggagacactcatcgttacagggcaggcatgggcgcctctctgctgagcactggtcaatgcttccaagtggctgctccaatctgcattcccaggagcaaagtgtaagagccccacagccctcaccaatccccgtcactgtgatccctttcattttggcccttcttgaggggagggtggcatttcctgtggtttaacttcacattttcctggtgactaattgtcttgagcacttttaaaatacattcattggccatttggagactctttttcgggatgtgccagttcaaacatttttcccattttttaatgaatcttttttgatttatagatgctcatattttctaaatatgtcttcagtgagaaatatgttttacaaatgtcttctcccagctgagattggccttttcactctccatgctgtcttttgaagaaacgttgttcatatttttaatgaagtcccctttatcaattacttatttcatggaaagaaaacttttttgttatgtttaagaatcttgctttctctgaagaatgtgaaggtatttttcttgtgttttctgctgaaaatgttattgttttacatgtcacatttagatctgtgacccatctcattttatgttttctgcaacatacgaggtggcaaccatgaggggtgtgtgtgtgtgtatgtgtgtgtgtgtattgtaaaccaaaaataaaattctaagtcttgcgatcatctgaattgacccctcctgttggcaagggtgttccaaagctaacctgaaaaactaatctgaccgtgatggggagagtgaggtcagacgtgcctcatgacaccctcctcccttttggaatttctgctagaacagacttcttaactctgagaagaaacatttacagtctcttctctcagaagcctgctgcctggagacttcacctgcacgatgaaaccttggtctccacaacctgtgtcttaacccagacagtcttaagtccttagacgataactttactctttcaaaaaattgccactcagaaaatttttgaatctacctttggcctagaagcccccgcttccagatgtcctgcctttttgtactgaaccagtgtacatcttacatgtatttgattgatgtcttgtgtctccctaaaatatatgaaactaagctgtgcctcaaccaccttggacacaagttctcaggatctcctgagggctgaatcattggccattggtcactcatatctggctcagaataaatctcttcaactattttacagagcttgactcttcactgacaatatctataagtgtttgtgtatatatagaggcatgtatatataggtagatttgtatgtgtgtgtgtatatatctataataaacacaggtctatatagaggggtgtgtgtgtatgtatgtatagatatgtgtgtgtgaaagcatgtgtatatgatatttattcagaaccatcctttacccagtgaactgcacccatgcctatatcatgaatcgagtagccacatgtgtgtgggcgaggactgctagactcttaccattatgtatacaattatgagagagagggagagaacctgagttaaacaattagccacatttctctttaagcctactgagaaaaagacacagggacccagcagacatcagaacaccttgttggggcagctcgcactggggcgcaggtggcagaagcctcacgggattctgtacagcaggaagagaggccggcttcagcccctcctgcctgacagcacaggggtcttgcctggcctgggaggagccgggattggaggcaggggctgctcctgcctccagaggtttccaggagactgcatgttgtgccctgccggcatccacacatttgtgtagtacccactcccagacaaggacactcatagacttcctccggcctcgcgtgggagccgagcctgtggtctgcatctcgctgtgctccacgcagctcctgcatgcagctcctgcacgcatcggctgggctcgcagatgtcaggtccgcctcctttcctcttccctgagcctctgccgagccctcccgacccgagggtcggctgctcccttccccgcctgagtcacttccgtgactctcttcatcctcagagccatccccttcctcatctgtaatgtgggaagaacacccacctcgcagggttgtttctggttgaaaggcagcacttgtcaggctccttgcacgctgtccacagccggccatcgtaagagttacggcgactgtcacctctcagccactcctcggcatcggacctcttggctcctggccatggcattgaccacagaatgtcataaacagcccagtgtgtttttccacgagagcagtggtcggaggctcctgcaggtaaatggctggagattgattgacgtgggaatatcacggcatcacagaatcagagcacatttgttcacggtgcaggaataacatcaagtgagtggtgagctctaaaggacctggccctcgaggtagctcacaccctcgatgatgaatggagccaggccacaggtgaaatttccatccaggcgggacagactcaagccgggactgggttcccctgacgcccggcttcccaaatgtgcttccctcccggatgcacagagaacgaacgtggcatggacattgtgagctgcaggaagcgatcccaccagggatcaaaaagccaacttcctccagcggccattctgcactaagcctctttcgtggagttcacgttctgtccaatacagccttaaagcccatgaacaattctgggggagacgatcaggtctgaaaggaaaattccatatgggtatttaagttattggaagaacccttaagatctacctgggtttaacatagaatttgctatatgtaacttggtatatcattctctatagtcatttgcctaaaaatcatcaaaagtataaattcaatgttgcatctcccatccagatattttgtgttaaaaacacctcatatctgatgtctgacagctattttctttttttctatgtatttgccttgaattcacattcgtagtcaccttttttccctctcactttgtttttcatttgcattttgacctaattcatgaaattatccagcagggagagacctgatggagttttgctggaatgaagctccttgacacaatcgtctcctttttagaagtgcctgtagattgaaagttcaattgctcaaaacagtttgctaaagaacaaatgtgtgtctattaagagtttaagttgcacttgtaaatccaccaatggcactaagatatcatttagcaatattgacacttgaagtgataaaaaaacagaaaatacctttgacgtcaaataaatgtattagtctttaagaaaaaaagaggtggaattgaccttggtgtcttatgaaatcgcagaacatatgatgggtataaacaatgccagaataaacaagattttcaaagtttttggaaaaagctgagctcatgccgattatagaaagcatttgcatcttttgaagggttttcctctgagggttcaaatgtccctcagggatcatgctggtgataatcccagctcacaaactgactggtcttaattgccttcaatcaagtagctccagcaggagacgggaaaaatcaccgctgagtttcctcatacttctggccacctgacagggtgtcaggcgtttttggggacaaaatgaatcctcgcacacctggcccagcaggatgagggcatcccgtgtcccgctgctgccccgctgagaaagaggtgccgttacaggagtggaaagctgacttcgtccacagtttctctcccagcatttcacactgcattgctgtttgcttcttttcatgggcggcacacatctctggcactcagcgtgtccatgtgctgttactggatggccatacctggcaaacatattgacctgtgtcttgcggcctcagtccacagctttatgctcaagcgctcttcaagatggaagtttagaatttcttctttttggaattcagaaatcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatcctctacagatatgtatgctcatgttatatatttgatacattcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagatttagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatgtaatgagctatcattaaaatgatttttattcatgtatcagcaatcaattcaataacattgtcctccaaatttctaaacaaaatattggaaaatacctcatttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaatacatttttgtcagaatatattttgaccaatagaacaaaactgcagaccagcctacttatgggaaacttcaccatctagcctattggctgaagccattgtcatcgccaaatcaaacagccaaatacaactgactctctctctctctcaggagagacttaactttatttttaacttactttattttaattcaaattcatttattaatggttcctttgacaacccgctcacttctgaaatcagaaaaccagcaacttcctcagttcccacaagttcgcctggacaatcacacgggcaggaacaggcgcgacaccctggtggcttcatggtgctttgattaaaggatgttttatgccacaggatttcaaatgatctctttgtttggagtaccagaagtttctgtcctccagagaactgcccctggtacattctagaagggtgggagaccctccttcggaaaacaggggagtgggaaggaaccctgcaggcagccacctccagacagcatgtgctgagctcgggagagggtgcctgtgggaaccaagcctctggaatgagctcccttgaagccagtcatgacctgggcctccaggaggcctttcgggtcttctggggagctgtgccccttgggcctccggagagaccccacttattctccctgagaatggtgtcttatatctggaactcactgcttctgtgttcttctcccccatctcaaacacatccttgcatttgtctccacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagccttttactgggttcttgctcgtgctgggtgctgcgtgcaatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgctttccttcttggcctcagttggacaatccctaaaatgggataagactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgctccaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactcgcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactccagggcacagatctcctaggggcacctggagctctgtgaacaagaaccacaccaggaagtgcatgatcccaaagggtcatctttctgctaccacagggtcctcctatgtcctgaccaatggtctcttcctacccaggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaagtaagttttagaaaacgtttctatgtttgttatgaaactaagtgctatttaaaacgtcaaacagaatggtataaaacaaaatgtgaaagtctgtttctttgtcctattcccaggggtagcagttgtgaatatctggtgcatctcactggaaattccctgggtacacgtatatatagcatgtatgatagtgtgggtacacatatatatagcatgtatgatactgtgggtacacatatatatagcatgtatgatagtgtgtgggcagatgtgtacatagcatgtatgatactgtgggtacatatatatatagcatgcatgatagtgtgtgggcagatgtgtacatagcatgtatgatactgtgggtacacatatatatagcatgtatgatagtgtgtgggcagatgtgtacatagcatgtatgatactctgggtacacatatatgtagcatgtatgatagtgtgtgggcagatgtgtacatagcatgtatgatactgtgggtacacatatatatatagcatgtatgatagtgtgtgggcacatgtgtacatagcatgtatgatactgtgggtacacatatatgtagcatgtatgatagtgtgtgggcagatgtgtacatagcatgtatgatactgtgggtacacatatatgtagcatgcatgatagtgtgtgggcagatgtgtacacagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgtatgatagtgtgtgggcagatgtgtacatagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgcatgatagtgtgtgggcagatgtgtacatagcatgtatgatactgtgggtacacatatatatagcatgtatgatcgcgtgtgggcagatgtgtacatagcatgtatgatactgtgggtacacatatatagcatgtatgatcgtgtgtgggcagatgtgtacatagcatgtatgatactgtgggtacacatatatagcatgtatgatcgtgtgtgggcagatgtgtacatagcatgtatgatactgtgggtacacatatatgtagcatgtatgatagtgtgtgggcagatgtgtacatagcatgtatgatactgtgggcacatgcatatatagcatatatgatagtgtgtgggcagatgtgtacatagcatgtatgatactgtgtggtcacaagtatatagcatataggattatgtgtgggcacatgtattggcacatcacaggtgggctcgtgtgtatatagcatgtatgatattgtgtggtcgtgtatatagcatataggattatgtgtgggcatgtgtattagcatatatgatctcgggtgggcacgtgtgtatatggcatataagatagtgtgtgggcacgtgtgtatatggcacataagatagtgtgtgggcacgtgtgtatatggcatataagatagtgtgtgggcacgtgtgtatatggcatataagatagtgtgtgggcacgtgtgtatatggcatataagacagtgtgtgggaacgtgtttatatggcatatgagattgtgggcacgtgcgtttatggcacataagatagtgtgcaggcacgtgtgtatatggtatataagatagcgtgtggacacgtgtgtatataggatataatatagtgtgtgggcacatatgtatatggcatataagatactgtgtgggcacatgtgtatataggatataagatagtgtgtgggcacgtgtgtatatagcatataagacagtgtgtggacacatgtgtatatagtatataagataatatgcggacatgtgtgtatatagtatataagacagtttgtgggcacatgtgtatatggcatataagacagtttgtggacatgtgtgtatatggcatataagatagtgtgtggacatgtgtgtatatggcatataacatgctgtgtgggcacatgtgtttatagcatataagacagtttgtgggcacatgtgtatatggcatataagacagtttgtggacatgtgtgtatatggcatataagatagtgtgtggacatgtgtgtatatggcatataagatactgtgtgggcacgtgtgtttatagcatattagtttgtgggcacgtgtgtaaatagagcctattatcccatgtgtacctgcactttttctcatcctctgtgtcacatcatgtgcatgctcagtgcctggtaaggaccacttagcaatagttcttatacatgtctgcttaacattaagtgaacagaaatgtaattgtttacaacttagtattccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgttcactcttaccagaaaagaaagagacaatataggtagatttttaattttatttctctctggaaaccagccttgaagttaacaagggacattttctttttttttttttaagacagggtctcacccagtcgcccaggctggagtgcagtggtgcaatctcggctcactgcaacctccgcctcccgggttcaagcaatacttctgcctcagcctccctagtagctgggactacaggcaggtgccaccacacccggctaatttttgtatttttagtagagacggggtgtcaccatgttggccaggctggtctcgaactcctgaccttgggatccgcctgccttggcctctcaaagtgctgggattacaggtgtgagccaccgtgctcagccaacaagggacattttctacttaagagcacagatggtttcgatctcatgtcctctctaacattcattcaataaaacttcactggcagttattctgtgccatgctgtgctgtgtgctaggcaggctgaaaaggaagacaggctggtccctggaaggtgggcaggacagttacataaaccagcagttacaaaattctgggcatctgcagaggaggtcccagtgggcaaaatcaagacatctaaacaaaatatcccaaaaggaataatattgggggaaaggtggaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccggatataagcgattctcctgcctcagcatcctgagtagctgggactacaggcatgcgccaccatgcctggctaatttttctatttttaatagagatggggtttcatcgtgttggccaggctggtctcaaactcctgaactcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaatgaacagtctgccaagcagaggccctcgttcccagctaagtggctccccagcagaatctgtgcaaaaaaatgactgagttatgcagcctggagaagcagtggagatgggcacctattatctatcaggtcttgggttccaggcttgccttgtaacttattatctgcgtgtatataggtttgttgtccataaaaagagtatatttcccaggctggccttgtaacttattagctgcatgtatataggtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggagggagcacgttgggtagggagctgcactgagagaactactctgtgtggaggttgggctcccctggagctgcactgagagaaccactgtgtagtggggtgggggctccacctttgggctcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttgggggccaccatctgggtgggaaggacacgggtagccctgaggccagacaaggaccccaggaaaagcccagcccttcagggccacacacaccgtgggggaggttggggggcctctggccagggcatcatcctgggcacgttctgctggtatccagggtcacgtgatggttgtggtgagccccacacacccgcccccagaggctccttcctccacccacaatactcagttatgtggatggctgcgttcgtataaagataaatatattaatgtgggttcaaacgttctttggcctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgcgggcagcaggcggggaggggctggaccatctcaggcggggagcctgcagggcttgttcccaggagctgaggagctgactccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgtaggtaaacacacacacacacacacacacacagatatcaatgaaagataaatgaacagcaagatgctgtttttaaacatacagactggaaagaaattatgaaattttaatttagtgttgttgagggtattgagaaatcatttgcatccatgcattgctgtgcaaaagtaaactggtgaatacattcgggacacgatgtgacataaggtatgaaatgaaatcaggcccattcacagcaccacaagaatcttccctagggacaatgtccaaactgcccttaaaagtgggtgaatatattagtttgtcacgattgtttatatcaccaaaatactgaaaaactttaaacgttgatcacaggctatgagcatgagaaacacaagcaactttagacaatcatgttatacagtgatattatggaaatggtaaaatgttgcccagcttagtaaaattttagatgatattgtacttgtcacttttcttatttcaaaatgttcattattgagcatatattatctttgtacttagagaaaaataacaataaaattatttgtaaacaattttaaaaataaaaggcaagaccacatctggcagggaggacacctgcgtgcccgtgggtgagaacgtgggagaggccccagggtgggtctccagggcactttccagggctcttggtgtcaggcatgaacctcctggcttgcagttaagagtgtccatcaattattcagatcctgtccatccccagggcagccttcagtagttgagtgattgagctaacagtcactccagtgagatgaaaaatataccgtatactctaggagtagctccataaacccaatagatgacacatcataaatcagtgcttttaaatgtttgatgtcctttacactcaaagcatccagtttggtctctgagtatttacggtggagtgagagggtggaagttcttagtgagcttggagcaagttgggacttttgaatcccaaagcaaaacagaaaatgatccacacaatttatcatatctatgtttattcagttttcctaagagaaacatgtttccagcaactacacgagactataaattaaagtgttttgagtctctgactactgatcactcagcccagggagctgtgagagctttgcagcatcctctattttaggactgggcttttcttcatgaccttgctccttctggtctcggctaagtgggggtgcaggcagcccgatgatgttccactgggtgctgcaaaccccccatccactgcagaaaatatgtagctatgaatgtatcgacaacctcaaagctatgcaagcctcctcatgcacaccaatgtgtatctctaggtacatattacaaagtggagttagtgggttatgaattatgttcatgttggaattttttatttccataagttattgagaacaggtggtgtttggttacatgagtaagttctttagtggtgatttgtgagatttcggtgcacccatcacccaagcagtatacactgaacacaatttgtagctttttatctctcactcccttcccaccctttccccctgagtccccaaagtccactgtgtcattcttacgcctttacatccccatagctgaggtgtcacttatgagtgagaacataaaatgtttggttttcaattcttgagttacttcacttagaataatagtctccaatctcaaccaggtctctgcaaatgccattaattcactcctttttatggctgagtagtattccatcgtatataaaaaatcacagtttctttatccactcattgattgatgggcatttgggttgcttccacagtttggcaattgtgaattgtgcggctataaacacggatgtgccaatgcatttttcgtataatgacttcttttcctctgggtagatacccaggaatgggatcgctggatcaaatagtagttctacttttagttctttaaggaatctccacggtgtttttccacagtggttgtactaatttacattcctaccagcagggtagaagtgttgttcccttttcaccatatccacaccaacatctattattcgttgattttttttattatggccattcttgccagagtaaggtgctaatgtgttgtgttttgatttgcatttccctgatcattagtgatgagcattttttcatatgtttgttggccatgtgtgtatcttcttttgagaattctctattcatgtccttagcccactttttgatgggattgtttggtttttcttactgatttgtttgagtttgttgtagattctggatattaatcctttgtcagatgtgtggattgtgaagattttctcccactctgtgagttgtctgtttactctactgactgttccttttgctgtgcaaaagctctttagtttaattaagtcccaactatttatctttctttttattgaatttgcttttgtgttcttggtcattaaatccttgcctgagccaatagcaagaagaatttttccaatgttatcttctagagtttttatggtttcaggtcttagacttaagtccttgatccatcttgagttgtttttgtataaggtgagagatgaggatctagtttcattctcctacacatggcttgccaattatcgcagcatcatttgttgaatagggtgtcctttgcccactttatgtttttgtttgcattgtcgaagatcaattggctgtaagtatttgggtttatttctgggttctctattctattccattggtctatgtgcttatttttgtaccagtactatgctgttttggtgactatggccttatagtatagtttgaaatcaggtaatgtgatgcctccagatttgttctttctgcttagtcttgctttggctatgcaggctcttttttggttccatacgaattttaggattttgttttctaatttgatgaagaatgatggtggtattttgatgggaattgtgttgaatttgtagattgctttcagcagtatggttgttttcacaatattgactctacccatccatgtgcatgggttgtgtcccatttgtttgtgttgtctgtggtttttttcagcagtgttttgtagttttccttgtagaggtctttcatctccttggttaggtatatttctaagtattttatttttttcagctattgtagaaggggttgagttcttgatttgattctcagcttggttgctgttggcgtatagaagagctactgatttctgtacattaattttgtatccagaaatttttctgaattatttgatcagttctaggagctttctggaggagtctttagggttttctaggtaaacaatcatatcattagcaaacagcaacagtttgacttcctcttcgccgatttggatgccctttatttcttttgtctgattcctctggctaggatttcgagtactatgttgaagaggagtggtgagagtaggcatccttgtcttgttcccattctcagagggaatgctttcaacttttccccattcagaattatgttggctgtgggtttgtcatagatggcttttaatacattgagctatttcccttgtatgccaattttgctgagttttgatcataaaaggatgctggatctttttgaatgctttttatgcatctatcgagacgatcatgtgatttctgcttttgattctgcttacatggtgtatcacatttattgacttgtgtatgttaagccatccctgcatccctggtatgaaacccacctgatcatggtggattatctttttgatatgcattggatttggttagctagtattttgttaaggattttagcatctatgttcatcagggttattggtccgtagttttcttttttggttatgtcctcttctggttttactattagggtgatactggccttacagaatgatttaggaagggttgcctgtttctctatcttgtggagtagtgtcaataggattggtaacaattcttctttgaatgtctggcagaattcttctgtgaatctgtctggttcttgactttttttgttggtaatttttatattaccatttcaatcttactgcttgttattgttcagggtgtctaattcttcctgacttaagctaggagggttatatctttccaggaatttatccatctctaggtttcccagttgatgtgcataaagctgttcatagtagccatgaatgatcttttgtatttcagtggtgtcagttgtaatatctcccattttgcttctaattgagcttatttggattttctcttcttttcttggttaaccttgctaatggtctatcaattttatttatcttttcaaagaaccaggtttttgtttcatttatcttttgtattttttttgttgttgtttcaatttcatttagttctgctctgatcttggttatttcctttcttctgctgggtttgggtttggtttgttcttgtttctctaattccttaaggtgtaaccttagattgtcagtttgtgctctttcagattttttatgtaggcatttagggctatgaactttcctcttagcaccgcctttgctgtatcctagaggtttcgataggttgtgtcattattgtcattcagttcaaagaatttttttttttttgagatggagtttcgctcttgttgcccaggctggagtgtagtggcacaatctcggctgattgcaacctctgcctcctgggttcaagtgattctcctccctcaggatcccgagtagctgggattataggcatccaccaccatgcccagctaatcttttgtatttttagtagagattgggtttcaccatgttggccagactggtcttgaattcctggtctcaggtgatccaccagctcagcctcccaaagcgctgggattacaggcatgagccactgtgcctggccccgaagaattttttaatttccatcttgatttcatttttaacccagtgtcattcaggagcagattatttaatttccatgtatttgcatgattttgaaggttccttttggagttgatttccagttttatttcactgtggtctgagagagtgcttgatataatttcaattttcttaaatttattgaggcttattttgagacctatcatatggtctatctcagagaaagctccatgtgctgttgaatagaatgtgtattctgcagttgttgggtagaatgttctgtaaatacctgttaagtccatttgttccagggtatagtttaaatccacagtttctttgttgactttctgtcttgatgacctgtctagtgctgtcagtggagtgttgcagtcccccactattactgtgttgctgtctatctcatttctcagttctgttagtaattgttttataaatttgggaactccagtgttaggtgcacatttatttaggattgtgatattttcctgttggacaaggccttttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatgcattctgcaattctgtatcttttaggtggagcatttagaccatttacattcaatgttagtactgagatgtgaggtatcattccattcattgtgctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtctgggaaagattgttatctttccttcatttatgaagcttagctttgctggataccacatttttggtggataattgttttgtctgaggaggctgaagatgggtcccaatcccttctagcttgtagggtttctgctgagaaatctgctgttaatctgataggtttttactttataggttacctggtgtttttgtttcacagctcttaagattcttttcatcatcttaactttaggtaacctgatgacaatgtgcctgggcaatgatcttttagcaatgaattctccaggtgttctttgagcctcttgtatttggtgtctaggtctccagcaaggccagggaggttttcctcgattattccccaaaataaactttccaaacttttagatttctcttcttcctcaggaatgctaattattcctaggtttggtcattagacataatcccagacatcttggaggctatcttcatattttcttattcttttttctttgtctttgttggattgggttaatctgaagaccttgtctttgagctctgaagttttcttttgcttgtttgattctattgctgagactttccagtacattttgaatttctctgagtgtgtccaatgtttcctgaagttttgattgttttttatttgtgatatctatttccttgaatatttctcccttcacttcttgtatcatttttctgatttccttacattgggctttgcctttctctggtgccttcctgattagcttaataattaaccttctgaattctttttcaggtaaatcagggatttctccttggtttggatccattgccagtgagctagtgtgattttagggggtgttaaagagccttattttgttatattaccagagttggttttctggttccttctcatttgggtagtctctgtcagagggaaggtctagggctctagcctgttgttcagattctttcgccccagggggtgttccctggacgtgattagtactctccctgtttcctagggatgtggcttcctgagagctaaggtgtagttattgttatctctcttctggatctagccaccaagttcaaattgttacaaagttcagctggcagtttccttctccctgtggccttttacaggtgcctctggcagccctcctgaaggacccctgtgaggcaaggtggaaatggcttcctaggggacccagagatcccacagggcttttctggctgcttcctctactcttgtattccactcggctctctaaatggactcagctccgggtaaagtcagaatcttctcccgtaatctagaccttcaggttccgcagtgggggtgcatgttcagggtggacgatctctcccacttcctcagtttgggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatgattgcttggcttttcattttgtttacggtgccattattcataaatttaggtcgattttcgtcaattttttttcttctctatgacatctacattgttatcttactgagcaggtcttccttatctggtatatataataatatatatataaatatatttttctatattttattttaaacatattaaaaactgggcttgatatacaactttgttttattctgactctattttgtgtagataaaatactgctttagtgagtaacatttaaaaaagccatggtgagagcagcatctgcctctgttcctagataaagggcatgattctgatgtttttcctcacatactgtgtctactaggaatttctgctagacaacttcagttagaaatttgaaaatcttatttgtaatttcccaagaattttaatgaggcttgtgggttccagctttactcaataccttcccagcatcggcagaggaggccacagggcttccacttcacttcattattgtgtgagctacactggtagatttccaacgcagtgccatatttacatggcctgcatgatggtgatgcaggttttcatttattcttggattgaatttgctaatattttatttgaaatgttgcctctctcttcataagcagagttgtgctacagtgctcttttccgatgctgcacctatttgggtgttacaaacacaccagcatctgacagtggtcaggggttgcccattcttttactatgctcaggattaccttgtctaaaatcaaatttgggctttttgttttgaataactggtagagcttatttgtgactctggtcctgataacctctggggtggcagatctttggttatgggctcagttctgggtgcagttagtctattcgagcccataagtctttcctgttctttattttctattaccttcctattacactttttcatctacttcacatttctcaccctcttatgctgaaagcgagttgagttacgttcactgtgtcgtgctttttgacaagtgtagttaagactatgtattttcctgtgacccccccccacaaattttgatacatggtccttacattgatgttaattcaaaataggttttaattcaaataagaatttcttacattaaacttgagcacccacatgtaagtgtaatttcacataaatgtaaaacttaaactgtgcctgactctcccgacacgagtctcttcctctccctccctcatttgctagactctcctcctgctcactcccatgttctccactcatgcccctgcccccaaaccaatcatttgactcccaaatgttgatatttgaagtgtgtgtaggggaaagggggcatgataaatgaaactagaatagtaagaagctggtgtagacagcatagtgggctcaaagggattcactgggcaccccgttttaatcagcatgcccttgctatgatctcagcactcatggcatgcccttcccatgatcctgatgttcatggtgtgcccttcccatgatcctgatgctcatggtgtgcccttcccatgatctgaaagttcatagcacatgcccttcccatgatctgaatgttcatagcacatgcccttcccatgatctgaatgttcatagcatacccatcccattctttgagtgctcatagtatgttcttcctgtgatctgagtgctgatatcatgcccttcccatgatgcaaatgctcacagcatgcacttcctgtgatctgaacgctcatagagtgctcttcctgtgatccaaatgctcatggcatgccctttccatgacgtgaatgctcatggcgtgcccctcctgtgttctgaatgcttatagagtgcccttcacatgatctgagtgctcatggtgtgtcctttctgtgatccaaatactcatgctatgtccttcccttgatccaaatgctcatggtgtgtccttctgatgatctgagtgctcatagtgtgctcttcccacgatatgagtggtcacggtgtgccctttccatgatatgaatgctcacttggctacacctaaagaagtcatgcacaagcatattctcttgaatgttgttaacaaaaacaagactatgctgagtacacgttctgtatcttggattctcactcagtagtgatgtgtcctgggaatccccccagtggagcgccaagccatccctgcttacggctggactgttccacactccgggtcacagccatgggtgtgcccttccgtgttacagcctctgccacagcgtggatcaccagaagtgacactgccaggttggaaggcagctttagcactgctatgctggtactactgtctaaaaattctgtgaccctcacagcaacgactgagtgtaccccttactcacattcgccatccacactggcaacagccttgtttttttctcatttttttctgcttgtttggcggcaaaaaaaaaaaaaaaaaaaaaaaaggagagagagagatatttcgttgttacattagttgctttccctgaatattagtgaattttaaagttgtcctttatttatctttttttggcaatttgtatttgttcaacgaatgatctgttcatagcctttgtccatttttctactatttgactgttaattgattttaattgctcctttccactctagatgttaactctctatctctcacttttcttacaaatgtttttctacagccccatcaatacagaactgtcagcatgaagcactttcatattttataaggccaggtctacttatgtgttgatggcttctaggctcagttttggttcaggaatctcctttgctcgaagtcgacagtgacctcctgggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccgcatcaccattcttttccctagtttattaaggaataaataaataatggaatttgtatcttcatataaactttaaaattaatttatctatttcaaaatgaaaaagtactatcattattattgtaaatgaaattgcatttaatttatacattcatttagagagaaatgatcttttcccaaattttttgtatatttaatgatgttttatgattttctttttgtagatcatgtgattattttgttaaatttacacacctgattttgatcaacttttttgtcattatgaaagggatttttttttctccattaccattcatggtactttgctaaagaacaaaacaaaaaagaaagaaggaaaagaacagttttatacttatcctcagatcgaagacattttttaaagaaatgttatcaattttttagaatttttagatgttgtagacatctaacatagcattaagaaaaaataattttattatgttttaaatcttattttctcttacagtagctttaccagctcttattttattttctagactttggtctaactgagatagtactaagtaccaacaatgatagcgggagtttctgctagtccttaattttaaattaaattgttccattgtttcactgctcgagataatatttgttattgtttctacattatattttagcaattccaatctattctatttctatttaaccaggaatggtaagtaatagtaaattgtgttattgcattttaagtacctatgatattaatttttcttctttaatttgctgacaccctggaaaatacaactctattctccaacacggaaccattctgtgaatagattctatttgactatggtaattgctgttttgatttgctgccctatcttttattattttatttagaagggatattgatctgtatgccctgtccttgtcctgttttcatcagaggccaatacaaaagtttcgctgactctgtagagtgcactggggcccttttcatcttttccatggctgaaatagtttaagcaaccttggagttacctatcctttcgagatttgatagaagtccaccgtcaatgccatctgacctctggatttctgatcaccttgtctatctcttccatcctcattgtccattggagttttacatttcttcttggaaaagctgtggttatttctattttgttagggagtcatcgatctgttcttcattttccaatgtgctgccatgaaaccgcatatacagtcgctcctggttcttctcatctctcctgcatgcctgagccctgctcctttctcatggcaaatcctgcctcactcggtgctctttctttgttttccacactgggttgtgaagcagggcttcatgttttcttcccaccaggtcttttattcatagttaattattttaacttctgcatgcattaatttaactttctcatttatttgtgctttagctctttgttacttaactaaattcttaaaatagctacttaatttcttggtttttgttgttttgatgaaagcaatttaaagagcacagattttcttctgaggaaggctttgctggtgtgcttgaattttcttaacaagtgagttaacttttcattgatttctggagacactttcagctcttcttaagagtctctttgaatcagtgagtaggagaatttgcagctccttgttatttatttgtaattttattattatttgtgctcttcaatttaattcctctatttcctcccattcttggggcctctgggcctgtatattctgaagggcgtgcactgaagttccggctgtcacggttttcttggctttcctactcttttgctgaatttcagctcctccctgggttccctgctggccccaagtactcacctcgtctactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttcctactcctcagtgcccaggctgcactttgccccgagaggagctttccccttattttcactggtaataataatgtcctattacgagaagaccgtgatcttcaggaagagtctctttcggaatctgtccaaccccggtgatcttgtgattctggatgagcgatttaacctcctaaatctgataacgcccagggtaggccctgaccccgtgacacctcaccagggaggaagagctgacagggaaagggcacatgctctctgcagcccacagagctcgactcttcccaggaaacctgtaaatctggaaaaaatattttagatctccatgttacagatgagaagatggaagctggccacagccagagttggaatcccacccaaggtctcctcactcccctcaagctgcctttacactaaacagtgatgcccacaaaactcggagactgtttactcattgtgctcctaaaccaagtccatggcactggaaaggaagaagtcagctcttccgaaagtcagaaaataaaccagaccggggattccatgagcagctagagcaggtctgagcaggagcgagactggctcaggccaagagcgtctgagctttggggagatgtggactcctaggatgtggggtccatcctctgggttcaacctcttccaggcaagagaccaccagtgagcaggctgaggggaggtgcggggctggctggaccgacccctgcagcctcttccaggcaagagaccaccggtgagcaggccaggggggaggtggggggctggctggaccaacccctgcagcctcttccaggcaagagaccaccggtaagcaggccggggggggaggtgaggggactggctggactgacccctacagaggactggaggggcagagaaacgtgcggcgctgcggggtcgtcgccggcctcgaacttccagagtcttacaaagggtgcacgggggccctgggtgaccttgaactcccctttgcctgcagctcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattcccagaacaacccttggaggtgggtggaccaggggtgctggtgtttttgtatttcagagacagtgcagtgaatgaagaaccgactctgtgtgaggattctgaactaacaagttagagtctatttgaaacctttcttcattttatgactttcttaagtatcacatgagagggtcttgaatggagagtcaagttggccttttattaattgtgtgatggagaaaagcacttatgcacctggaaatgcggtccctgactctaggggtctcacaggttgttaggaagaaggatgggctgtttgatatgcgagtcaccgtgtgtgtctgttgcaccaggccctgtggcggcctgggcatcgtgtctgcagtcctagccgggagcctgcagggaggtgcgcgtcagtcctgttctaaaggaggcactggagccttgtccgaggaggcacaggggctgtgtgtggcaccggctgcccccgggcaccatgcgcccctgccgctttctggccttcactgcactggggtccaggccccaaaggtcagagcagagggtctgggaagcctccatgcgctgggtgttaacccttagttcctgggtggcgaggggacctggagcttcctggaacaggggctggcagcagcaggccctcacacttctccggcaagcacggcagacgggctcactgtcctaacacgcatccacacagcaaacacagcagacgagctcactgtcctaacgcacatccacacagcaaacacggcagacgagttcactgtcctaacgcacacatccacacaggaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaaccttctttgagtgagaacctcatccagcccagggagctgtgagaagagcagctgcctctgatccctggagcccgttcacagagcgggaaacgcccaattgtcacgcaccctgttgtctttcttctccatggagttctgggattatttagaggcgtgaattattaccaggcccagtcattgtagattagagacagtttaattccaagttactgagaatcctactgacctagaaataatgacatttggttgctgcggctgtggctgctgctgctcctccttgtcctcctcctcgtcctcctcctcctcttcttcttctccttcttcttctttttttttgagacagtctcactctgtcacccaggctggagtatagtggtgagaccttggctcactgcaaccaccacctcccaggttcaagcgattctcctgcctcagcctctcaagtagctgagaccacagacatgtgccaccactcccagctgatttttatatttttaatagacatggggttttgccatgttggctaggatggtcttgaactcctttcctcaagtgatccgcctgcctcaggctcccaaagtgctgggattacaggcctgagccactgcgcccagctgccttttcttattattaatgaaataataacaacagcaaccaataggaaaagtgttcttctctgtttcatatttaccttcctcaattcattttctgtgtgttctgctttttaaaaaactgtgaacattcttttcttcttggttttacatttcacttttgaatttccttttgtatttttttcagttaataggtcctctttggtgctttttgcaaaaacctttgatacattaaaataataagttgtgtttaacgtgtcgatagagccactgctgcgacttctagccgtatttgaaagatccacggtggcctgggcctggaagcctcatttttctctccctggttctaccgactcgtagtttggtaactttgtaatctgaatctctcttcttctgaaaaacattagataatgaaaagagatgccagggcaaccttatgaaagagaaatagcatccccccctctatcacccctcaaaccccctacacacacacacacacacacacacacacacacacacacacacacacgagccagccagggccaggctaatgcacacatcagcaagagacaggaaaggtcatctcagagccgggagtcacagctttctcctccatctgtccacaccacctccctcctccttcatccgtccaaaccatgtttctcctgctgcatccgtccacaccacctccctcctcctgcatccgtccacaccaccttcctcctgctgcatccgtccacaccacgtccctgctgctgcgtctgtcctcaccatacccactctaatttgtcagggcccaaccacagccgcccccactctgaggatcttggctcctctaatttcttttgtcgaaagctgagagctatcccctccctcagccctgggccacaggacttctgctgtgggcatgtttgggagggatctgcagggccgccctctgtgctggttcctgggatccggcatctctcgggggactcgcacgtaggaagggctgataaagttgctcttgctggcttgagatcccacaggaccctggatccataagccctgcttcccaccaggaggaactgaagctcttgctcttcaatcccagaaaaccctagctgctttaggtgtgtcataagacaagaactcacaatcagttgctcactttggtgataacttttgtgttctacagacaagaaaagaatgagaaaggaaacccttcccagcacaggtgtgagggaggcagagaggaggtagccatcctcggggagtctgggtgtgccatccaggcagcatggagtttgggttccacagggtgaaaagataaagacatcccaaatatctggcgtggatgttttctatgccccggccatcagatagcagacctatttctggagcacagccttgatttccccagatatccagggacccacagaagctttgctttggatgtgtgtggaggtagaaccagaccccggagggactgcagatctccctggacatccccatcccgggcaggcagatccatgtctcggggcaggggctgcatccctgggccactcggctgctgacctttgctgtagctgagtactttttcagattggttgctcttccagagcaaaggagcagatggataaagtcatgcttccaaggctggaaagaaagagaaagggccgttcctgcagtgggtgctgttgctgccccacccaggcccctttatctgcagggccccatcccccagtggcctccaatgttggctgacaaagtctcctggtcgttcctctccaggggtagctgtggaggctgttccctgccctgcagggacagccaggcccctacctcaaggctggaccaagcccaggtgcgccatgctgcagggcttcctgcggaggagcacaagccaggcctggctgtgtcacgtccttggggagctgggtgcctgctcagcctcctccctggagcaccctcagcaagcatatgggagcctcttattggactaatagggcatgtttgagaaaatgctgagtgatgttctgcgtagagcagggtaggtgactttgaaagcagtcgagagtcagaaagttcagaggagcctgtgccaggggctacgcggctgtttcccaccgtcggtgacaaggatcgcatctccaggtctcttcgtcctggtctccccgtgtgctggggtcctggcttcccgtcaccttcacgcccatcattttcccaagtgtggacctttcagtcattcccactggtgagttgtgaaggcaaagaaatggagagtggccacaagtcagcacctggtggctttggcagaggctgtggggaaccaggaggctggggtgagagcagacgtggaggagcagcttgaagcagcctgggaagatgaggcctctacatggcaccgccagcagaggaagaagacatggcccacctgggaggtgagcaggaggggcacctgacagcgacgatgccccggtctcacagtatggcgtctgcccaggtccaatagttcagagtaaccatttcccccatgcgaccaggtaaagaaataccagaagcatttccagaagaattgccatgaaaattccagagagctgtttacaaggttcaagtgttttctttttctctttttgagaaagcatctcctctatcacctaggcggaagtgcggtggtacaatcatagctcactgcagcctcaacctcctgggctcaagcaatcctccacctcagccacccaagtagctgggactacaggtgtacaccaccacacctggctaatttttaattttttaaatttttttgtagaaacagagtctgactgtgttgcccaggctggtcttgatcttgggctcaagcaatcctcccactttggcctcccaaagtgctgggattacaggcgcaagccactgcgcctgactcaagattcaagttttaaggccccattggtcagaacaatgggtgcttctgcccaacctcgacggctcccaggggaggctgcagtatctgagccaatcacttaccagggatgtttcagatcagatgaggaggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcagttctctgcctgtgcttgctgcatcccctggctcacaagtcaaacttcaggcaggcaagaaggggaagaggtgtcttccttaaaatagcttgcacttgaatttgaaattgtctcagtccctgggctaaaaagagagaggccttttcctttctattgtagtgagaagaaaccaaagaatgttccagggaacagaaggtgctgcctgagttctgaatgtgggaagcacacggaccttctcacgcggttaggaggagccccttggacacctgtgtggttcagaaacgttgccacataaattgcacctgaggtggagaggctgtttgcacgatgaagtcgtgcaactgctctctgggatgctgacccatagcacagtgcttggcaccaatggatgaactagcacagggacggaaaccccactgggaaacatttggatgctgccttttcctccttgtctgtccaggtctccgaggtggagcgggacagcgagggcaggtgcaccttcagtgaaggcccaggccacacaagactcacggctctccctggtctccctgaagggccaaattacgtgcttaggaaatgcattctggcacatggaagaaacatattacaagtgtgtaaataatattggttatttttaaacaatccacttgccttcctaaactggtaagctaaaagagaagattcatattctagaattattcctattatgcttcatttggatgcagtttattgaccaaaatattccccttaaataccaaaacaacttgacactgatttttctgtctgaaagaaacactgttaaacctgaaagtagaatcttggtacataattctcctgggaccatgtatcaaatcgtaatttccaggccctgtgattgcaactgtaattttccatcgacagagctctctgccatacaacatgctttgatttaatcctcacaaaggctctgggaattaggtattattgttgctttgtagaaaaaggaactgctccccactgtcaatcatccagccaggagtctagctgcccagcctggcccggtggccattgttggctcgacagaggtgctgtctcttgccactgccagccccatcaccatcctgggaaggaggctctctagtcagccctataaacgcacctcctgaatatccatgaaaaaatcagcaagaaggcatttctgggaagttcagctgaggcccttattacaagacgagaagggtccagttccctggggctgtcaaggaagatgctcttccacactgccgctcgaggcgaccctcctctggtatcctgggcctcactgagatgcttttcctatctgcacagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtgagtgagtgcggtccctgcagctggtccccatgaactcttccttctttttttaatttttttaaattatattttaagttctagggtacatgtgcacaacgtgcaggtttgttacgtagggtatacatgtgccatgttggtttgctgtacccattaactcgtaatttacattaggtatttctcctaatgctatccctccccctgacccccaccccacgacagacgggatatgatgatccccgccctgtgtccatgtgttctcattgttcaattcccacctatgagtgagaacatgcggtgtttggttttctgtccttgcgatagtttgctcagaatgatggtttccagctgcatccatgtccctgaaaaggacatgaactcatcgtttttttatggctgcatagtattccttggtgtatatgtgccacattttcttaatccagtctagcactgatggacatttgggttggttccaagtctttgctattttaaatagtgctgcaataaacatacgtgtgcatgtgtctttatagcagcatgatttatagtcccttgggtatatgccaagtaattggatcgctgggtcaaatggtatttctagttctagatgcttgaggaatcgccacactgtcttccacaatggttgaactactttacagtcccaccaacagtgtaaaagcattccttttctccacatcctctccagcatctattgttttcctgactttttaatgatcgccattctaactggtgtgagatggtatctcattgtggttttgatttgcatttctctgatggccagtgatgatgaacattttttcatgtgtctgttggctgcataaatgtcttctttgggaagtgtctgttcatatccttcgcccactttttgatggggttgtttgttttttccttgtaaattggtttgcattttttgtagattctggatattagccctttgtcagatgggtagattgcaaaaattttctcccattttgtaggttgcttgttcactctgatagtggtttctattgctgtgcagaaactctttaattagatctcatttgtcaattttggcttttgttgccattgcttttggtgttttagtcatgaagtccttgcccatgcctatgtcctgaatggtattgcctaagttttcttctagggtttttacggttttaggtctaacatttaagtctttaatccatcttgaattaatttttgcataaggattttcgcatcgatgtttatcaggtctcacttctttcttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagatgcctgtagtcagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttctttatattcctttcccagtagtctgtaagtccttctgggagcttctaacctgtctcaaaagttgaccggctccaggcgtagtggggagtggggagggcaggggtgctgcagtgcgtccggcgatacctgcttagatgagagctgagtcatgcacagtgcaccagaggggcaagggccagcctggccctcagcaggtgcccggcatttgaagacacccaggtcatcccacacaggacgatgcatgtcgtgatttctaagtcttccttttgggcatcctaaggccaaaccgatcctttaaagactctggtggcatgcagtggtgggttcacacgccactgagatagaccgaccctgacaggccgtggggcctgctttccatgcggggcctttggagatgacaggaacagtggtccccaggcaccctggccactccctcagctaagctgagtcttcctttcactgttctggatgttagaattcagcaaacgcttcttttttttgtaatctttctgttgctgagaaataaaacaaaaagctttaaaaactggtgggctccttctccaggcccctttctttctgagggtccatcccccatgagccacattgtcagtgccagcccagtggttcacctgccaacaagggcagtgtcctgaggacattcaggaaactctggaatcacacaagctgaattcatgaacttacacgaaggtttgctgaggataagattgagctattgggctgggcgcggtggctcacgcctgtaatcccagcactttgggaggccgaggcaggcagatcaccaggtcaggagattgagaccatcctggctaacacggtgaaaccccatctctactaaaaatgcaaaaagaaattagccaagcatggtagcgggcgcctgtagtcccaattactcgggaggctgaggcaggagcatggcgtgaacccgggaggcagagcttgcagtgagctgagatcgccactgcactccagcctgggcaacagaaagaatgagactccgtctcaaaaaaaaaaaaaattgagatattgttgtttctctagaactgagccaagagctgtccttgccttgtgcatggtattttccaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggtctgccagttccttcccttgcacacctcatgcagctgctgcgggatttgccgagctagcaacctgctgctagagagactgatttagaggaaaacaatcacaaatctgaggccttctaagcaacggctcttaaagggctccagttcattcagctaaagtggccacttccagcttttcttagagatagaaatggcacgaagagggtggttctgaacctcccaggaacgtatgagctgggaccttgagaaacagccgcttctagtagagggaggagggagtgcgcgggcagacaatggcaggtctgtatctggtatcccgggaagctcctgggatggctagagtgcccccctccccttctcctccccaccacaaggtcccagagcctgcaaagatcattccgtcacatcaggactgctgttaactaactggtccaagctggcccctggcaggagtggctgctcctctcaggccagcagccccctgtgctccccacaccccacccggctcctgcctttcccaggccccacccggcagcctcctccctgacctgcccagtttccaactccctgacctcaggcccacctcagccttccctcctctgggctcctaggtggttcggttgtctggtcaacctgcagcacctgtctaggcccgatcccctgacacctcctattctgtgtgcagctctgttctctccacgtaccctgggagcttgggaggtgccctcctgttgtgtgtgggtgacatgtgagatggacagtgctggcaagtcctgccctgccccgtccctgggccttcctctgtcccctggcccttcccccatccctgtcttcctcaccagtggcatctggaagggctgggatcagcagccacacaggctgtgaatatctggggactaaatgtgagttgggaggatgcagaaggggcccctatgtgtgtcaggataacgcacactgtccccctcactccctgcacccaaacacagctgctttcttgttgccagagctcagggagcacagcctacacatgccttcacatgcccggcacatacccagcacacacccgcacatgcccggcacatgcccagcacatacctgcacatgcctgcacacacctacacatgaccagcacatgcccacacatgaccagcacatgcccagcacatacccagcacacacctgcacacgcctgcacatacccatcacatgcccagcacatgcccagcacacgcctgcacatgcccagcacatgcctagcacatacccagcacacacccacacatgcccagcacacacccacacatgcccagcacacacccacacatgcccagcacacaccttgcctctggctgggaccccctttgctgctggccctgctcaggccccacagcttgatctcctcatgttcccactgctgacttccccaagctaactgtgccacagagtgggggaccccctcccggctctcacaacccccaccttcctctgcttcacttttcaccaactgaaatatggccaaaggcaaaaacccatgttcccactggcctgtgggtccccccatagatcgtaagcccaggaggaagggctgtgtttcagggctgtgatcactagcacccagaaccgtcgactggcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttgagcgttggggacgcaaacacgagagtgcttggtgtgagcacacaggaggagtcacgacagagcagtgtaagagccgccacgtgggtcccacacagggggagtcacgacacagcagtgtaagagccgccacgagggtcccacacagggggagtcgcgacacagcagtgtaagagccgccacgagggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagctgccacgtgggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagccgccacgagggtcccacacagggggagtcacgacacagcagtgtaagagctgccacacatgggtccctgcggcctgcagttcgaagcccactgcatgtgttagcactctataccccagccaccgtagaaggccggactgcgatcactttctaaaagatggatcgagagactgaagcacagacagtttaggcaacttccccaggtctgaattccagcaactggaggcatcgatgcaccagaaaggccacaaacctggcagaggcttcattagatctgatcagttcgatctgaggataaatcagataaaagagaaacgctcatgtctcagcaagctgagctgtgatgatgatttccactacgccctgaaatcttttgttgtactttacggggaatataaaatgtacaaccttccccaaaacacttttttgctgctgggcacagtggctcacgcctgtaatccctgcactttgggaggccgaggcgggcagatcacgagttcaggagttcaagaccagcctggccagatggtgaaaccctgtctctactaaaaatataaaaaatcagctgggcgtggtggcagacacctgtaatcccagctacttgagaggctgaggcaggagaattgcttgaacccaggaggcagaagttgcagtgagctgagatcatgcctctgcactccagcctgggtgacagagcgagactcagtcaaaaaaaaaaccaaaaaaacacttttttttgcattcccgtttctgcagtgtctcccacaggcagggacatctaaagtgatgttctttcttcccagctctgcggcctctgaagctgtgatgagcttcagcctccatgtctttacctcctgcacaggccttgcatattttccctctagagttggaaaaagatgcaaatgtgtttcctcttagagcaataagaaaggaaattacccttctaacttcgttgttttttctttttgaaattaagatttccatctctcacaggtattagaaatgttttaattattttggactacttaaaacagtttgacaatggtctaaattgactatacagaaactttctctcctcatttgagaactttaatttgctcattattttggtttctcactagtctgaaaataactgcattcttttagtaaatatttaatgaaataactgctgtgtcccccaagccctgtggcaagcaatgggcgtctgttttctatataaaccaagtgtctacaggttacctattcctggagctgagaaatttgtggggtatgtttgggatggtctaggctacagtagattgggtgataaagatgaaattttgttggaggtgctgagatggagagacacagagcctcttgacggggcaaagcacttcccggtggctttgatgagagggctgggatggcccatctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcaggtgactctaggagcacaagagtcagacacacacttgttcctcctgagggtgaaccagggagccacctgctaagaaatggactcaatggcacctgacagcagttttctaaaagctcaggattttttttgttttttgtttttttgagacgaagtctcactcttgtcacccaggctggagagcaatggggtgatctcggctcacggcaacctccgtctcccaggttcaagcaattctcctgccccagcctcccgagtagctgggataacaggcacccgccatcacgcccagctaatttttgtatttttagtagagatggagtttcaccatgttggccaggctggtcttaaactcctgacctcaggcaatccgcccgcctcggcctccaaaagtgctgggattacaggcatgagccaccgcacctggcctctagaagcgcagattttgaatctcactcatgccttcctctttcactttgtccattcttccaatccctcttcttccaagttgttcccacccctttgctccatgagtctgtttaccacatgggcatccccttcccagaccaactggaggatgcctggctatttctcccagttctgtttggtctaaacatgagacaccaagaggcccaaccttctgtcccatgaaagcctcactgtccctggggggaaccagcccagtgctcacatgttgctgtgcgtgtgcttgtccaggacttctgctgggagcctgtggtgggcagggcgctgagagtagaaccagacagtcttagctaaagcaccacacagggcgggtggatgagtagagacagtagcagaggccctgggcggcgctctgatcagaacccgtgggagtgagggtcgcccatccttgaggagggagcacttctggaggaggtgacagctgaaccaagaggagtggatgagggacgaaggcagatgtgaggagtggggcacagggaggggcacgagtgtcaggcaaaggcgcagccacagagtcagaccatggacgggggcctgggcagggagcagctgaggcgtgggtcagtgagcaggaggaggagtgagaagagaggccagggattcaccagggctcccaggaagaaaagatctccagtcttcaatatggagatgagtggccagacagataaagatatttgtgtgtgtgtgtgtgagtgggtgggggggggggtgctggcttctgtgtgtgctcctgatgtcattgtgggaggcaaactctgaagaggatgcagagctgtgtcagttgccctgtagaggcaagaactaagtgcaggctgggcaataacaggaatgcacttagatgtcacggactcagcattcttgctgtctccagctcctttatgaacaaacctgcaaaaagagctctggcgtccgagctggaacattctagcctggcaaactgccgggcagtgtcacagggtgggacaggactctgcccggcatctgagctggaatatcctagcctggcaaactgctgggcagtgtcacagggtgggacaggactctgcccggcatccgagctggaatatcctagcctggcaaactgccgggcagtgtcacagggtgggacaggactctgccgggcgtcggagctggaatatcctagcctggcaaactgccaggcagtgtcacagggtgggacaggactctgccctgctgcgcttccagtctcggggaccatggcatgagtgagatgggctgaacaaaagttcagttctgtgagagaaaccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcgtcttccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaatgcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccagtgttaggattttggaacaacacagacaaaagcaataggaaaatgttttcttttgcttttaaatacatccctacctatccaattctctctctatttttggtagtcactgtgccgaggtcagatttttgttgtaaaggatctgtgttcttcccagagagtgcacctgccacacgctggggctcctgtcctttccccagtgtgacttttatctctaatttctgagatgcagcctttcaaagagctacgaacacctgggtagaaatcaccaggagaacttgtctcccttatagctgtgtcttcagcaaacgtgcggtttggaattctctgggacatgggaagccactcgctcagaagggggaagatttcaccagcttgccccatacgtgtgtctcccatgcgtgttttatgccacctgtggctgaagcgccatctgaaatcagtgcagaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtgggacttcatttcttcacattgcaatttttctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagtacctgcacctgagtggtcccgggtgctcaggggtctgggcagacgccacagggtctccttcaggtcctcagtgcctgcacctgagtggtcccgggtgctgggggtctgggcagacgccacagggtctccttcaggtcctcagcgcctgcacctgtgtggccccgggtgctgggggtctgggcagacgccgcaggagaggctggcagcacacagctgtgggcagctggtcttgagtgcctgccctgggggttctccatgcactgtgaccttactcactgtctccttctctggaggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaaggtgaagttcggtctcctctcacaccacgttacagcacgtgcatctcatcaaacaaagcttatcttccccaggagctgattttaacttttcactgtttagaaaatagtgtcaacgccctgccttacaccctcagggcagctcctggggcggggcggggcggggcggggcccttctctagtgagaaaggaactggaggcctagagaaagggagcccgcggggcccgatctgggaagaggccgtgtgtgctgcgtgggtgctcagtgagtgaccacagcagggctccccggccctggcaccagcccctccagggcacaagcgcacccgtgacagggacgttggtgtgtggttttcttttctcgtagtttgactacatgtcaacctgtccacatttcatagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaaggtcagtcctttcttcaatgacaattacaaaacatctgaatgtttccgatataagttaacaatgcaatgtcattgaaaatttcttcgccaaaaggtgcttctgaaactgttatcttcccaggagcaatctggggatagaaagcaagggctctccccttggctggccatgttcccagctggcctttttctaggtagtgaggcctcaggacaggcacgtggaatcgtgaccaatggggtcaccggtgagggaagagagaggggagtccgtgagttccaggcaaagttgtggtgaactcgcaggggcgctttctcaaagggaacacagcagcaaacgtctccactccaggaacccatagagtaaggctcgcctccacctccacctcctacaggtggctgattcccaagcccatgcctggtcctcctccagccactgggttccactcccagcctcccgcatgtttaggtgtggacaagtgtggcttcctggcggtaatttgagagcaggatggggaggcacctttcaggccgcaaggcaagacagccgtgggccacttccacctgctcctcccatgtgctggcttgagcgggtgtcagcccagggcacctgggagcaggtgtgctggacaacagagcctcccggggggagagccgtgtactggggttcctctgcggggaacagcagaatgagagtccccatctgactgttctgaggcagagccctctgggtgcgactcctgaggctggggcttcctgtcagagcagcttgcgtcctccaactacttcagaactgccctgccacaaaacctggaccgctggttctggtctcatgggacagtggcgtcagggcaggcaggagcaggaatggctgctgttctgggaggaaggctgctcagatgacactcaccagcaatctttagaaggccaaccagctgccttcagggactgcattttaggagaggaaagttggcatcagactcacagtctcctgtgagctacgtgctatgagctgcacttacctagaccgcagaagaaagagatggtctcgtgcaagaatctggctggtttgcaagcagaaatacaagcaaagtccacagttttcagttttctcagagttttcagaagatgaaagagtcctggagccagtgctttgggagacccaggtgagagaatcctctgaggccaggagttcaagaccagcctgagaaaaatagtgaaaccccatctaccaaaaaaaaaaaaaaaaaaaaagtggctgggagggggatggtgtgataagttgcacaaggtcagtgtgctcaatgccagtgaactgtacatttaaaaatggcagaggtggtaaagtttacattatgtataattcagcacaataacaaaatttccatttcaattttgaaagtccaaaatgtttctccttgaagggttgcagtggtcaactgcttccagaccctcagtcataaagggagaggctgagaccctgtgtgcaccagagacccaccaggactcagtgctgtggcaggggtcaggtaggggtgcggctcccgccaagtctgtggtctcaggtgccctcccgggagccaccttcccattagaagaggagagaagggatgaggagaggaagaaacaaagctggcctggggaacggtgcctcggaaataactttcaaactcactaacggcacaaggagctgcctgggcatggatagggcagaggcctgctacataggtgagggggtgtcatcactggaaaccagcagcctgggctggaaaccctctgtttaaactgttaattgcacaatgccagatttgcagacgtgctcccctgctgcattttgggattggtcatgaatgacagtgtacaaggagatcacccagagattacagtgccccagagaacagcagaccaggatgtttctcccagagaactttccagaagcctcggtgatagaaacacaactactctgtcgggtgatgacatctgtgtaaactcgtggttgctgttaacactattgcatgactcctgaccataggctctgccactgacacttcagtgacaaaagggtcacgaatcgcaaggttttcctgttcccttggcttagagactgcacaaacttgaaacggccacttcactcacgattcctggttttccgtgttggcattacagttaaggaattgatggcaggtgcttcagggtatagcatgttgcgtgttctacgttaacaagccttcctatggtgcacttcactgtacacctgcgtctctccttgcccaaatacccagacgtttcacgtgtccattttagcttcattttaagtatgaatgaccccaaagtgctactcacaggcatcttcaaggtgcaaataaaagatgggtgagaccttagagtggatcaggaagggagactgctggagtcctacaacctgcctgtgtggagctgccccctgtgcgcgtgccctctgaccttccgcctgccctctgaccttccacctgccctctgaccttccgcctgggacgttgctcatctgtctcctaagtgaggaatgctccttcagcctcctgtagaccatcctatgccatcaaaatcactcttctgttcttgaaattttttcatttatcttccttgatttttagtccaacaattaacagctgtctgaagttaagatccattgtaagaaggactatttctgaaccagtctgggtgctccccagggtgcaggggcctgtctcggcatggtgcgtgcacagcagccagtgctcctggtgggctccctggctgcagcaacatcaccaaggagcttatcacacctgcggcgtctggggccaccacaatccctgagtcagggctgcagcaacaacatcaccaaggagcttattacacctgtggtgtctggggcaccacaatccctgcgtcagaatccacactcttcacaagaccccatgagactgtgtatatgaaggtctgagacacccatcggccaaccctaactcatcctgtcttctctctctagttcactaacttgggcccaacttcatgttctcctgccacagacatttccgtagccatttaatctgtctcccaaattgctgagcctctgtgtgcctccacggtttcaaatgtgaaatgaggacaggaataaggcattgatttaaattagttataaatgcacagtacaaagagcggggtgcaggcctgttgatattaacactgtgagtgctcaggagccgtgttctgaatgctgggacagccacacccagaacaattacactacacagttagcagggcgtctgttgacttggaagagtgttggtgacatgtcactcaataagcatgtaagctacacagcaatgtgtacattgggaatctgttcgggttttttttaaagcagtgggccacaggcacacacatcactttgatgagtgtcctcccgaatgtgaggggagcgctaggctctgctccagaacctgttaatactggagacctcggcagcctgagatggggacaggtaggagagattgctaaccttcatcaatacaactcttttttttgtttgttttatcatatctgtaattaaaatatatcttagagataaatgacaaaactccaaaatctggtacaaatgcgtgtgcacagatatttttactacagctgttccctgcactagaagtttcaaaatcgagaatcacaagggaaaaaactcaagtataacagacaggaaactttacgtttatggtaaattgataagaatataagcactcaaggagatcctcagtgaaacctcatcaacacatctgcggctacagaaaggaaggctacgggcttaactgaatatttgatacagaaaaacaaatagtattcgctgctctcttctctattcaaattctacttattcactcaaactcattcacataaaaacttgatattaaggccgggcgtggtggtttatgcctgtaatcccagcactttgggaggccgaggcaggtggatcatgaagtcaggagttcaacaccagcctggccaagatggtgaaaccccgtctctactaaaaatacaaagaagaaaaattagccgggcatggtggtaggcgcctgtaatcccagctacccaggaggctgaggcaagagaattgcttgaacccgggagatggaggtttcagtgagccgagattgcaccactgcactccagcctgggcaacagagtgagactccctctcaaaaaaaaaaaaaaaaactggcaaatgcattgcagtgagtctcctctgagtgcctggatgctgcaaatttcaaatagataaaaagctgtgagtcagtggctttttccatgagttattgtcaggaggttatgcagtaaacgaatatacataaatgctttgtgcatattatggaaaatacagttcgcaaccagtactaatttacttagagaaatggaaacatctgtgcactcactgcatgtggagactggacaccacagccatctgcgcactcactgcgcgtggagatgtgtggacaccacggccactcttcttgaaactcaaggcgaagcagtcggagagcagagcctcggcctccatgcaggtcaccctggtatctggggacactgcggctgaggctggtttcctcctctgtcgggagcgctgctcttcagacaaggccgatttgtccccctccttcctgtccatcctgggaaggagacctacacagcgctggcccctgactcggccttctgcttagaagaaactgaccgtgggtggagcgttgtgggccaaactgtgcccccaaaaagctatgctcaagttctagccccgtgtacctctgcatgtggcctgatgaagaagcaaggcctttgcaggtgccgtcgagttaaagtgaggctgtcgggtgcatcctgctccaatgtgcagtgccctcataggaagcagagacaagacacagacgggaccctgtgaagacccaggatggaaataaagcttctgccaggcatgggccccccaggacccaccaggagccagggcatgcaggaaggacgccccccgactcccgagagcctgctgaaggagcaccacccggccgacaccctgatttcagacctgtgacctctagaactcttggaggatgcatttctgttgcttggagccatccactttgtgatgatttttcccagcagccacagggaactcataaggatgagtctgaactgcagggatggggtgaggagagggggcagaagctgctccaagggaactccccgagagggatgcagggatgtgttggcagctgccattcccattctgaggaccccattgcacatcccaggggatggagagaaaatgggcttgtagcgttcatgggtgatgactttgatttttcacacgatcatgatggaaacactccctaccccagaggcggctgcagatgccttcacacagctctggtgctccacagctctgcataacgggatgcaggaggggctggttccaggggcagctttagccaagaaagaccttctaggtttaacagccttgacatggttacctgtacatgaaacactttaatagctgctgctagatagagacaattaacagccgatagtcaatagctccaatcccttgaaatttcttgacccttttcttatacttctttttatttttttgagacagagtctcactctgtcacccaggctggagtgcagtgccgcaatctctgctcactgcaacctccgcttcctgagctcaagtgattctcctgcctcagcctcctgagtagctgggattacaggcacccaccactgcacccagctcatttttgtatttttagtggagatgggatttcaccatgttggccaggctgggctcaaactcctgacctcaggtgatctacccacctcagcctcccaaagtgctgggattacaggcatgagccaccggacccgacttcttatactcttatagaatggttgtcattatcaataatggcattattaaagaccgtactgtttagaaagcctgagatatccctgacaccctgctagttgtcataagcatcgtctttgattccacgcccatttttcacagctgacataatgatacccattctgtaactgagaaaaccagcatgggccaagcctcccccggggttaggagtgggcagtcccatccaatgcagcccctcaccctggggagcaggtggccagccgaccaccccagctggccttcgaggcctcacgggtctccggcactgggtcgcctgagcactgcccaggttcgcacattctcatcgtcctggggtggccgagtcggggaccaagaccctgtggcctatgtggaccccggctcctccactcagcggtgagactggggagggtccctccacctctcccagtgcttttgctctgtctagggatgtcgtcagcaccagggccccaggagtgcagggaggttgctgcctccagcctggccctcggcggaggctgcacccaggccagctctgttccctccagacagagcagctcctggaagagctcgtgttccccacactgacagcacctgctccatttagagaatgcgcactgggcatgtagagaagacctgtgacacgctacagcttcttttctaaaactggccagaaaaggaacattatttgaacaaaatgtacagcaggttatctggaaacatacgcctaggggatgagatactaggttgtaggattcttgtgcagggggagcaggagcaggaggggaccccacatcctcactggcggtggcaggtggccccagtccttgctctcagaggacctgccggccagctgggagcatctgcctgggcgaagcagaccctgccccaccctcaccctggccccttcctgcccccgtgtcctgcacttggccaaattccacattcccaggcagaccctgatttcctccaggaagtctcctgtgactcgggcctgagtgagccccagtgtgtggactccctgcaggctcagagcccgtggccagcgcacatctgtctgctcctcatcaccttttcggatgtgccgggagcagggggcggccggttccccctagaccaggtgggatggcaggcaaagggctgacctccccagagagaagcacctcccagaacgggggtcgctcgcgggagatgggggtgcagccgcttcctctcacgtgtgtggccttgtgtgtctggcagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtaggtgaggctgttcccctctctctctgtccgtccatttgcgagtttttgtaaaatgaagaaaagtgtgttcaagttaggcaactgtcaatcaccatcttgattgggaagggcggagatgaataagacaccaagcccacggtgcccgaggggcgtctgcgctgtgctgggggcagaggatgcacttcgtgtgcctgctgtctgcagagaccctcgaagcacactgaggctggggacggcagccagaatgcattgccagacaaggcccacaggtgtatacccagcctagatcacaccccagacaaaaaacctatgaaacaggcaggattcattacagacccatccatcacctctcctcctcctgggacccctccaaatgcacccgactgcaccctgaccagggccagcagcacagctgcctgcctgttctcccacctccacctccggatgtccccgcccggcatggggcctgggtgctcaacatctgcctcggatggccttgtccagtcccccagctctgcactcagctcagggacagcgtcttcctcaccgctgcctccaagccaggtgccagctacgcccaaacttttgacgaatttactcccctgaaaattgtggctcttaggtaagcactatctttaatcttcattttatagaagaggatactagtgataagagagggcgagagacgctcctggtcacacagccactccgtagctggccgggaatttgtgttaatagtctggcttccagctcttatagaaaaataattatttaccagactcaagttacagacagacttcctttgagctactgtcataggggagagaggtctccagaaagaaccaagtgcaaggctcaaatgcagcaaaggtagctgggacgtccagccagggcggagaggggtcagtgcaaaacgcttcatgactcaactgcattgaggagcttctgctaaactggaataataggattcttgctgaaactcagctcctcagcgaagggcacaagggccagggtcaaggccagttatcaagcaagtgagtctgaaaagagatggccaggacgcggctgcccggggccttcagaggctggggaggctctttctggggctctcaagctacatccgcttgactggcacgtcccccactcctgtgtcaggcatacacccccttcctgtgtcaggcgcaccccctcctgtgtcaggcgcaccccactatcctatatcaggcacatcccactctcctgagtcaggcacaccccaccagcttgtgtcaggcacacacccccacccccgtgtcaggcacaccccaccagcctgtgtcaggcacactgccccatcctgtgtcacgcacaccctcccacccccatgtcaggtgcacccctcttcctgtgtcaggcgcatcccccccaccccgtgtcaggcacacccccaccaccatcctgtgtcaagcacaacccccctcctgtgtcaggtacagcccccaacccccatgtcaggcacacccccactccttttgttgttgttgttgtttgtttttatttcttctaaaaaaaaagtgataaatgatgtgaagaacatgcaggtttgttacataggtatacgtgtgccatggtggtttgctgcacctattgacccatcctctaagttcctcccctcatcctccacccctcaacaggccccagtgtgtgctgttctcctttctgtgtccatgcaaaggaaccatttgtttacttaggggttgcggagaaattcttgtggctttctttttggcagtttttttttttttagttttattattattatactttaagttttagggtacatgtgcacaacgtgcaggtttgttacatatgtatacatgtgccatgttggtgtgctgcacccattaactcgtcatttaacatttggtatatctcctaatttaacatttggtatatctcctaatgctatccttcccccctcccccaaccccacaacaggccctggtgtgtgatgttccccttcctgtgtccatgtgttctcattgttcaattctcacctatgagtgagaacatgcggtgtttggttttttgtccttgggatagtttgctgagaatgatggtttccagtttcatccatgtccctacaaaggacatgaactcatcatttatggctgcatagtattctatggtatatatgtgccacattttcttaatccagtctatcattgttggacatttgggttggttccaagtctttgctattgtgaatagtgctgcaataaacatatgtgtgcatgtgtctttatagcagcatgatttatagtcctttgggtgtatacccagtaatgggattgctgggtcaaatggtatttctagttctagatccctgaggaatcgccacactgccttccacaatggttgaactagtttacagtcccaccaacagtgtaaaagtgttcctatttcttcacatcctctccagcacctgttgtttcctgactttttaatgattgtcattccaactggtgtgagatggtatctcattgtggttttgatttgcatttctctgatggccagtgatggtgagcattttttcatgtgttttttggctgcataaatgtcttcttttgagaagtgtctgttcatatccttcacccgctttttgatggggttgtttgtttttttcttgtaaatttgtttgagttcattgtagattctggatattagccctttgtcaaatgagtaggttgcaaaaattttctcccattctgtaggttgcctgttcagtctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccattgttgtttttgtcaggtttgtcaaagatcagatagttgtagatatgtggcattattactgagggctctgttctgttccattggtctatatctctgttttggtaccagtaccatgctgttttggttactgtagccttgtagtatagtttgaagtcaggtagtgtggtgcctcccactttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggtcattttcaccatattgattcttcctacccatgagcatggaatgttcttccatttgtttgtatcctcttttatttcattgagcagtggtttgtagttctccttcaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttctttctcctgcctgattgccctggccagaacttccaacactatgttgaataggagtggtgagagaaggcatccctgttttgtgccagttttcaaagggaatgcttccagtttttgcccattcagtatgatgttggctgtgggtttgtcatagatagctcttattattttgagatacttcccatcaatacctaatttattgagagtttttagcatgaagggttgttgaattttgtcaaaggccttttctgcatctattgagataatcatgtggtttttgtctttgattctgtttatatgctggattacatttatcgatttgcgtatgttgaaccagccttgcatcccagggatgaagcccacttgatcatggtggataagctttttcatttgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattcccgctttttgtattgattggaatagtttcagaaggaatggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaagaagtatgtgtcgaggaatttatccatttcttctagattttctagtttatttgcgtagaggtgtttatagtattctctgatggtagtttgtatttctttgggatcagtggtgatatcccctttatcattttttgttgcgtctatttgattcttctctcttttcttctttattagtcttgctagcggtctatcaattttgttgatcttttcaaaaaaccagctcctggattcattaattttttgaagggttttatgtatctctatttccttcagttctgctctgatcttcgttatttcttgccttctgctagcttttgaatgtgtttgctcttgcttttctagttcttttaattgtgatgttaggatgtcaattttagatctttcctgctttctcttgtgggcatttagtgctataaatttccctctacacactgctttgaatgtgtcccagagattgtggtatgttgtgtctttgttctcgttcgtttcaaagaacatctttatttctgccttcattttgttatgtatccagtagtcattcaggagcaggttgttcagtttccatgtagttgagcggttttgagtgagtttctgaatcctgagttctagtttgattgcactgtggtcggagagacggtttgttatttctgttcttttacatctgctgaggagaggcacacccccactcctgtgtcaggcacacccgccctcttctttcagggacaccacaccctcttgtatcgggcacaggataccctcttctttcagggacagcacagcctcttgtttcagggacaccacaccctcttgtttcagggacaccacatcctcctgtttcaggcacaggataccctcttgtttgagggacaccccaccctcttgtttctgggaaaccacaacctcttgtttcaggcacaggataccctcttgtttcagggacaccccaccctcttctttcggggataccccatcctcttgtttcaggcacaggataccctcctgtgtcaggcacaccccaccctcttctttcaggcacaccccaccctcttgtttagggcaaaccacactctctggtttcaggcacaccccccttcttctgtcaggcacagcccaccctcttgtttcagggacaccccacccccttctttcagggacaccctacccttttgtttcagggacaccgcacctcttatttcaggaacaggacaccctcttgtttcaggcacacacaccctcttgcttcaggcacaccccactctcttgtttctgggaaaccacaccctcttgtttcagggacaccccaccctgttgtttcaggcacaccccccctcttctttcaggcacaggataccctctcgtttcagggacaccacaccctcttgtttcaggtgtcctctctctgcacagcatttccccctcacactcattgttttatcagcctctggttttattcatgttttttctccatatgaaatagtatcctctcttcctttcaaaccagagcactctcaatcatggaaaattagaaacagcagctcttgcattcagatttttaaataaaatgtttaaatcaatggttcagatgtgaattgcaaaggtagccaggtagcgaagctgccacattcacagagaggagctcagctgctttccgcattattattacaaacctaagaaagcggattcagaaccctgctcaggtgaaggcagtggggcatttacgtcaagactgcagttttgctggactacagcccagaagcacttgctgtatttttgataatatctaaccctgtcagatggctccatggggccccaggaaacacttctactgctgtactccagctgaagccaccaccctccatccctcccaatgttttcttctggactcacccacagaaagaaggagaaaggagtcccagtggaggtcaggaacagccctgggagagcacccagagatgaattcgtgcctaagagggctcacccactacgtctcttcctcctcccggagagcacccaaagatgtgttggtgcctaagagaacttgcccactacctctcttcctcctgggccccctttgaatgcctgcaccgtgaccggggccaggagcacatgagcctaagaccattctgtgcaccagggcccatgtctgagagattaatacacaggtgcccagggcttctcctgtctccgtggtgatttacagacttagatttagatacagatattgattatggatagagacagtttagatataggcacagatgcagatatatagatatagatataaatttacatataggtataaaagaatagatttagatttcggtacaactctccctatataagtttagacgtagatacacatatagattcaggcatcgatataaaagaatagatttagatttcggtacagctctccctacataagtttagatgtagatacacatatagattcaggcgctgatataattatagagggagctctgcttttgcagtgttttgttcctaacgttgcggttaaaggaactgtattcatttcctgggggtgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccactgcaattacctcctcaaatgctccatccccaaatcagccacattctgaggcccagggtgttggggattcagcatgagaatctgggagacccggttcagcccacgacagccaattggtccatagtgccatcttttaatcttcagaataaaactttagaagaagtgtatacaacaggagcatgagttgcataaactaatttccaatattttgtttcaaacgtcttgttttagtttttgtcctgagaacaattacaacatacatttatctatttcctgcatcttttttttttttgagacggagtctcgctctgtcgcctagactggagtgcagtggcgcgatctcagcccactgcaagctccacctcccgggttcacgccattctcctgcctcagcctcccgagtagctgggactacaggcgcccgccaccacgcccggctaatttttgtttttgtatttttagtagagacggggtttcaccatgttagccaggatgtatttcctacatcttaaggactcttttctataaacgctgaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctgccttctggttctgtgtgatggatgtgatgcttgcatggtgctgtccctgccccgctccgcccctgctgggctcctggctgccgaacctgaagtcagggtccgccgcagaacacgtcttcccgctgagccctgcagcccctcaagcagctggctgcctccgaggagcttcctctccgacagctgccgtgtacctccctgacctccctggctgtgactcaggccctccggaggcactgggccaggccgccggtggagcctgatggtggacgatggtggacagtgaccttctccttctaaggaagggactgagggagggaaagtgcccccagagcatctcaggagctgggaggtgaacagctggggatgctggcttcagtgcttcccccaccaccagcacccttatgattatactgctgcccctgcaaaaatgaccatggaaaattaggatgctgggcatgacctttctgcatccctgacgcacaagcctaactgttgttgcacggaggccacacacgtccctgatgaaagagccctgctcccgtgcaagcagccgtcagtgccctctccgtacagatggcgcagccatcagtgccctctctgtacagacggagcaggccagcaggacccagcactgtccctggatgcaccagctctgtcactgctggctggaacacccaaaagggtgatggacatggctgtccctcagttttcagaatgacagcgtgaaacccaagcctgcctgcatgaggaagggtggacacagacagcagcagaggcctcggctgagtggacatgcgctcaggtgctgagggctgagagtgacccaggagcaacagctgagccatatttacagcccctcctacgagccctggctggaggccagaggttccagggaaggtgggcaccagggcccatgtctgagagattcataaacaggtgccacggcttctccttccgtcctcacagtgactcacagacaaggatgccaaggcctggaagatgaggcatggctgtgagaggagctcacactcccctggcctgcgagagctctggccccggccagcccgtgtgctgatcgtattagacggagtctccagagaaacaggagcaatcagagatgcagatgtatgtatagaaatagttatagattagagacatccatagagacacagtttgtagatgtagttacgtagatttagatatagatatcgatttaaatatggatatatgtagatatactatatatagatttacatagattgaacatagatatagataacaaatatgtagacatagatatagttatactgatttagatatagatactgattgtgggtatatatagttttaggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggcagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacctgaattctccaaaatcccagtgccctctgtctgcccagggcctgcccaaacccgatgccgtttctttccaaaggccctcgttggccttcacccagcctcagggactcccccttgcccagccccaccagaggggcacccacgcccacagcagagaactccagggctccccggggtggcactgaagaggtcggaaagccactccggcagcagccgtgacctttgtgatgcccccgtaggacatgcaggggcttcaggacctgtctcagctgggtatctcccagaagcacacagccttcaatctggttccaagcggatttactggctcttgaaattgaaaatgccaagaaacaaaaatttggagcaaagaataaaggaaagtttctgctgtgcggcatctggccttccccctgcccaggctcgtttcacacttttgggtaaacatggagctgcttacgtccctgctgtgggtctgccgtttgctggtgtgaggtgggcttcaatcagatgctcgccacggcccaggacgtggctcctcctctcactcaaggctctgatgtcagatgcctggctttgctggtttttgaagttccacaggtggcccctccagcccaagtttctcagaaccaaatccagccggaaatgtcaaacaccaattccagaatgaatttccacggctgccctgtcctgactgccctgacctggcctgtgcttacctggaattcccacccaggcctcgatcagctcagccttccccgcacccccagccccaggcacacaggcggagcccccacctctagcagccatgggggtgagagcgagtagcagcagatggaaacaagaacccagcctctttctggatgcaggaggagcggcatcccagggccagcaagcagctctgctccccatgggcttttagcaagaggctggtgtgctcaggttgccctgcagactcccctgcgtctgtgaaaggtggcaggaaggagatcctggaggcgggaggatggttagaggagcccaggaggaaaagtcatgaggtgcaaaggctaagaggacaggatcgttttggagaaacagtcaggatgcgcatttagggtttattcattcattcttgtatccaacaaatgcttgctgagtgtccaagacccatgcgaggaagacagccacggacaccacctgtgtctgggctgggaaagacccatgataggaagacagccatggacacgacctgtgtccgggctgcaaatgagacacacctgcaaatcatgcccaggtgctaagtggcacagggaaccgcagtcacccacagacgcattcatcaccgactttaaaaaatccagtgtgagaaatagaaccaaaccaagcacccattcccccagccgctgcctctgtctggtacctgaatgtgctctcttagccccagagcctatcttcaaccacacgtgatgatgtttatccagggcgacccatgtttgtttaaaaaaaaaacgctgattggtagtatttaaattcttatttaaaagtcagttttcgtttcatcttggatttctcctcggccacctcgaatgggtatccaaacagaaaagtcggtaataaaactgtggtcaaaggagctctgagttcagagccgcagtggccccaggctggcagctccttgcagaaagcacagaagccaagggctggagcccaggagccgttactcagtccccggctttttcagatgaagacacaggtccaggtgggaggcacttcctcaggcccctcaccagatgctctggggccggctcctgggctgcctctctcctctgtcccatcaggcctgcacttctctgtctgattcccaccaaccttgttcggtttctttctggaattggctgatgagacccaggatgagctccaaaatctgctgccatcccgtgcccccgtccccccagggctccagctctgcaaggtgctgtccaccttccttcaaccacggtttcacctccaggaggcttctgggaaagataaaatgcagccaagggcaaaacctcacagcgttataccgcgtcccttacagcccaccttgcgaacctttcccgccccggtccgaggcctccagggctccctgggtcctgtggtccactccgagggcactgagagccctccctggtttgggcagcaaggtgtgctttctgtcctgcaggacgcgtccatgccgaacccacagtgaggttccatagagagagctaacttctctgccctgtgtcccctgctggctctccccacacacgtcacattcggatctggacttagtggtctaaatggcttttctgggcagataaatgtccctccctccctgcgtcatgctgtggggtgaaggccactggcccaggacagggtatggcccagactcaggcaggacaacctggcttgcccaggccctggaaggttcttctaaccaggcctctttctgtgccccagactccgggaggctccctcgggtgacttggatctccatgtcgctggctgctctgctgatcggaggcttcgcaggtctcacctcgacggtgatttgcaggtggtaagtccttcactttttgactgttacttagacacaaagcaatctcctttcctctggacatggctgcaatgaagctgctttattttcccgaagctaacacaggttactggtatctcaaaggcattgatctcagagctattttgtacaacgtaatagactctccggatctttcattatgctttaaataatgaaagtggagtgatcatttgtacaccttaggtggtgtcaggtatctgtggacgaacattcagcaatatggaacacttttctaacactaaatgattgcattgaagtagtctcttgttaggagtaaagattcttacaaaggtttctcagagaaaaaaggtcatccatgaataaaaagttttattcttcagttttattccctcccttgagggcagaaattggaagttgaactttcatgttaaaaatggcgctgctgttgaaagactcagacccgcacctgagaggccctgccctgtgagagtgctctctgcagaaagagcccctcgaggcttcctcaggtgcggcagctggtccatgtccctagccctgaggaaccggctctgttccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctcttgagcaccaaactccttgagcatcccttccatttttaatgcacaattgttcattttatatagacagtattaaaaataacagcaaacactataagaagtcattgcaggcccaggctgggcccccagggccatgcccaggatacctgcagatagaggccacagtttctcggcttctgctctccctgagtgccaggctcccccccccaatatgccctgtgcacactcctgctgcagccagccctgccctctgccaggatgacccctgcagtcaccttcgccctccaccccggccttcagagctcctcactggcggagcccccagcaccaccccataccacacatgtatggattatccaagcctcccagcctcacccgataccacatatctatggattatccaggactttcccactctaaggccatcttccagggtgtttctcatcttcccaataatagaaactcaacattctagcaaacttcatttttctagcaacttctcagtacactgaggaacatctgccccttgaacaggaaatctttttcttacagtctttgcacctcctacaggaactggtttttaaaaacttgaaagcttagcaaccagatgttacccatgatctttatcgtttccaaagggccttgtcaagaatccacagttaatggactcttttctgttgtttttatttttgtgatcacttgtaagggaagactctgtacctgccatctgctctgcatcctgtctctctggggctgagatatggtagtaaagccagttccccatttcagttattctgcaaggcctctgacaactgctgtggttgacccagatgcctgcatttgatgcatgagcttatgatctatccggcatatgatatttcagtgacgtatttctgagtagcttcatagcttctaacaaaactaacatacaccataattcagacaactgtgagaaattccttccagtagagaggtgatagtaatggctaaagccatgtgtcagatgtaatgctaagtcatccttagccactgtctcctctgattttctgatcaatcatctgactcaggtgcttgccatggcttgaactgtgcattgcccagaacatatgtttatatcctgacctttaggacctcagaacgtaaccttatttggaactaaggtctctgcaggtgtaattagttaaaatgagactgtcctggagtagaggggcccctaattcagtatagctggtgttcctctagaaagaagagtttggacagagtcatgctgagcaggcgaaggccatcttgacgggaaggcagagatcagggtggggtttctctaagctggggcctgggaagatcgccagcagccacaggaactgggagggaggccgggggagccgcctgcaggcaccttgatgtggactcctgcctccagagctctaggtcataaactgctgtttaagcagccaagtctgtggtcctctgtgactgcagccccagaaaacttaatgaagtgctatgattgtgtccattttcagtgtagcatgtggaggtggagcgagagcctgttacttgctcaaagctggtaggcccagagcagatccttgaacccaagacctgtctggtgctggaggtcgtgccacagctgccctgcttctcctcgcgagaagattatattccacatgccagggctgttgtttcaaataatcattaccagtgaagattgaataatcacctactctctctacaagacactatactgatctgttttggaaagagagtactttaacctttaaatggtgtctctagttttagatggggtggtggcaggaaatattccctatgttttatgaatcatttggtctttaaaccttaaaaactttaataactaataattaaaaccctcagctaaccatgaaatagactaagcaataaaaattgaataggctgtaagcaaataacttcaaattagctggttctgtaattagaactatgaaatgtataattgtaacaaaaactgatacgactataatttcctattcataaacaattttgtatttgcaaacatccctataaacatctatcacattatcattataataaatattagtgtctgtagcccacactcacaagaaaaatagcaattttctttaagattgacagccatagatgaaatgaatacctttccaagggaacttgggagagaaatatttggctatagttgattttagactctggagttctaaaaatacgctaccaagcaccaatttagtttgcaaaatgccacttagctgaaagatatgaaaaagtggatgttaatgtgccatcacacgcttgagaacacaggcagttacagagtcagagaccataacagggaagaccctggggctccagggcagaaacatcctggaccaaaaccacagcacccccagacctgtgattaggtgagctcagaaggtcaagtcactcattaggaaatgtcttcccaccacctaccctgagacccctattctgctcccagcaaatgggctcaacacaatcccagcctcgcctccctgtgtcttattcttcagcttttaaaaacatgatcttatttccaccttagggcattattgtgcggtgaggagtagggaggagaacagagagggataggaagaaagagagacagagacagcagagagagacacgggaggggagagaacccagcacggtgtggcacacagcaggtgctcagcaaacacgtttcctctcctagtgagacaaaggtgtttgcttctctactctcctcgttttctacccaccctgctgtctggggtctcacactgtatgttttggtgtgattgttattaatgtgacaaattgttgatatattttcactgcaaatctacgattcggagttaactccatgaaaccaactcctccatcaactttcttgacactgcatttaaaatacctccacggtattatgcttgttttattgcattgaaattgttttcaccaagttgaattctttctgtgcaaacttttacactaaaaattcattcctcaaatcagttctttggtccatgtcagttttgccaattagacctttcgccatggaggtgttttcctttgtgttatgatttcttcagatccggctttcttagctcagcattttaaacttaaatttcatgaagactttgtctgtctgttgattcttactgtccagggaagatgctaaatgtgcagttccagtcctttctccattcgctcttgtttttattatttttaccaattctacttttccaccatcacttagttctgcaatttctgaaatacaatttttcaggttttccttgtcgttgataaacggtgccctatacctttttgctgttttcagttgtattttgtattgatattcctacctatggtatgcattataaattcaagaaagtttgaatcatttgcattaatttccagcaaatccatgggaaagccgcgaggtccttccctaggatgcagccaggtttgtcctccgtccaggacgtctaaccctttgttccctcctgcaccttcccacgctgtgagctgacgggtgctgtttctctaggcacgtcacggggggttcctgccatctctcctctctttatcattagattcataagcgtgctggagggaggccagctgggactaggccgaggcagccatggggcagtgggccacgggatccctgtaagccatgggtgaccgggtgccctcttcccccaggaccctcctccccagggaccctcctcccccagggccctctttccccagactcttggggtagagacggcctgagtctcttgagatggagtctgaagcttctggtcatctgaactgcatgttgatgacaggaattgtcttcaggacgtcattagggaagtccgagagaactggccctttgctgggggacagacgtagagtggccagcctgggctacacagcatgggggatccgaacctgttgtagtggaatccttcagagtcagtacggcgtctgtgaggcactcaggccccagaggacctggggaaggacctgcgctccttagagacccacgtctgccctggaaatgagcagggggagctgttcccagcctggtcacacatgaaccacagcaaggacagcctcccaccccagtccccccgtgggttcagctaaacgcattgtccagtttccagcccagaacccaagcctggctgccaggctcatctgctttctctgggcagctcccagcccctccctctgtggccccactttcttcacccacttctgagcaagtataggtgggaaatgtgccttcctccctctcctgaccccaggctgtctactccacaccggccctgccaccgtgccctggcagtctctctacccgacaccggccctgccaccgtgcccttacagtctctaccccacactggccctgctaccatgccctggcagtctctctaccccacaccggcccgccaccgtgccctcacagtctctctaccccacacctgcccgccaccgtgccctcacagtctctctaccccacaccggccctgccaccttgccctcacagtctctctaccccacacctgcctgccaccgtgccctcacagactctctaccccacaccggcccgccaccgtgccctcacagtctctctaccccacacctgcctgccaccgtgccctcgcagtctctcttccccacacctgcctgccaccgtgccctcacagactctctaccccacaccggcccgccaccgtgccctcacagtctctctgatctgtctccctctcctgcccccagaccatctacctcacacaggccctgccaccgtgtgatgcccagccattcccacttcttggcttttattcaagcctcaatctctccatagaatactccctccttatcatctcaacctggcttcgaatgttcaagtctgacacatcgcaaaggctacacccaaacaccacccactgtctgcaacctccccaaacccccactgtatgcaaggtcctcaaatccccccactgtgtgcaacctcctcaaatcccaccactgtgtgcaaccccccaaatctcccccactgtgagcaaaaccccaaatccccccactgggtgcaacctcctcaaatcccaccactgtgtgaaacctcctcaaatccccccactgtgtgcaacttcctcaaatcccctccactctgtgtaacctccccaaattccccccactgtgtgcaacctcctcagatccctcccacgctgtgcaaactccccagatccccccaactctgtgcaacctccccaaatctccccaactgtgtgcaacctcaccaaatcccgacactgtgtgcaacctccccaaatcctgcgcactctgtgcaacctccccaaatccgccccaccctgtgcatcctcccaaaatcccccacactgtgtgcaacctcctcaaatccccccaactgtttgcaacctcccaaatccccccactttgagcaacctccccaaatccccccactgtgtaaaacctccccaaatccccccactgtgagcaacctccccaaatccccccactgtgagcaacctccccaaatccccccactgtgtgcaacttccctaaatccccccactgtgttcaacctccccaaatacctcccattgtgtgcaaacaccccaaatccctcccactctgtgcaacctccccaaattacccccactgtgtgcaacctcctcagttccctcccactctatgcaaactccccaaatccccccgactctatgcaacctccccaaatcccccccactctgagcaacctccccaaatccccaccactctgtgcaacctccccaaatcccccacactgtgtgcaaactcctcaaatccccctactgtgagcaacctcctcaaatcaccccccactgtgttcaacctcctcgaatcaccccactgtgtgcagcctccccaaatcccccccactgtgtgcaacctcctcaggtcccccactgtgtgcaacccccccaaataccgccactgtgtgcaacctcttctaatcccctcactgtgtgcaacctccccaaatccccccactgtgagcaaactcctcaaatccccccaactgtgtgtgagctccccaaatccccccagtgtgtacaacttgcttaaatccccccaactgtaatcaacctccccaaatcccccctactgtgtgcaaccttcccaaatccccccactctgtgcaacttccccaaatcccccctactctctgcaaactcaccaaatcccccccactctgtgcaaccttcccaaatcccccccattgtgggcaacaacaccaaatcctgccactgtgtgcaacctcaccaaattccccccactccgtgcaacctccccaaatacccccaactctgtgcaacctcccaaaatcccccaaactgtgtgcaacctcctcaaatccccatcctgtgtgcaacctcctcaaatccaccccactgtgtgcaacctcctcaaatccccccactgtgtgcaacctcctcaaatctcctcacagtgagcaacctcctcaaatccccacactgtgtgcaaccaccccaaatccccctactgtaagcaacctccccaaatccctccactctgttcaacctccccaaatcccccccactctgtgcaacctccaactttccctcccattgtgtgcaacccccccaaatccccccactgtgtgcaaccccccaaatcccacccactgtgtgcaacctcctcaaatcctcccactgtgtgcagcctccccaaatcccacccactgtgtgcaacctcaggtcccccactgtgtgcaacccccccaatccccctactgtgtgtaacctcctcaaatccgctcactgtgtgcaacctcctcaaatccccctactgcctgcaacctcctcaaatccccccactgtgggcaacctccccaaatccccccactgtgtgcaaactccccacattccccccagtgtgtgcaacctttacaactctactcactgtgagcaacctccccaaatcgccccactatgagcagcctcctcaaatcccccaactgtgtgccacttccccaaatccccacattctgagcaacctccccaaatccccccactgtgatgtaacctcctcaaattgcccgcactgtacaacctcctcaaatctcccccgctgtgtgcaacctcctcaaatcccgactctgtgcaacctccccaaatccccccagtgtgtgcaacctccccaaatccacccaactctgagcaacctcgccaaatcccccaactctgtgcaacctccccctatccctcccactgtgtgcaacccccccaaatccccctactgtgtgcaacctgctcaaatccccaaactgtgtgcaacctccccaaatcaccctcactgtgtgcaacctcctcaagtcccccactgtgtgcaatccgcccaagtccccccactgtgcaacctgctcaaatcccctcactgtgtgcaacctccccaaatccctcacactgggtgcaacctcctcaaatcccctactctgtggaacctcctcaaatcccccccactgtgtgcctcctcaaatcccctcactatgtgcaactccaccaaatctcccccactgtgagcaaaaccacaaatccccccaatgtgtgcaacttcctcaaatccccccactgtgtgcaacctccccaaaaccccccactgtttgcaacacccccaaatttcccccactgtgagcaaacccccaaaacccccactgggtacaacctcctcaaatccccccactgtgtgtaacctcccaaaatccccccactgtgtgcaaaccccccaaatctccctatgaccaaaaccacaaatccccccactgtgtgcaacctcctcaaatccccccaatgtgtgcaagccccaaaatcccacccactatgtgcaacctcccccaaatccccccgactctgtgcaaactccccaaatcacccccactctgcaaactccccaaatctcaccccactgtgggcaaccacactaaatcccgccactgtgtgcaacctcaccaaatttccccgtgtgcaacctacccaaatgccccccactctgtgcaacctcccaaaatcccccacaatgtgtgcaaactcctcaaatcccaatactgtgtgcaacctcctcaaatccccccactgtgcgcaacctcctcatatcccccgactgtttacaaccttcccaaatctccccactgtgagcaacctccccaaatcccccactgtgtgcaacctccccaaatccgcccactgtgtgcaacctccccaaatccccccactgtgcgcaacctccccaaatcctcccactgtgcgcaacctccccaaatccccccgactctgtgcaacctcccccatccctccatgtgcaaacctccaaatccccccactgtgtgcaacctcctcaaatccccccactgtgtgcaacctcctcaaatccccccgatgtgtgcaacacccccaagtcccccccactgtgagcaaccaccccagtccccccacagtgtgcaaacaccccacatctcccccactgtgagcaaaaccacaaatccccccagtgtgtgcaacctcaattccccccactgtgtgcaaccccccaaatgccccccaatgtgagcaacccccccaaatcaacatgctgtgtgaaacctcaaatcccccaactgtgtgcaacctccccaaatcccctccactgtgtgcaacctcaagtccgccactgtgtgcaacccccgcaaatcctcccagtgttcgcaacctcctcaaatcctctcactgtgtgcaaccttctcaaatcccacgccactgtgagcaacctccacaaatccccccaactctgtgcaacctccccaaatctccccagtgtgtgcaacttccctaaatcccccaaactgtgttcatcctccccaaatcccccccccactgtatgcaacctccccaaatcccacctaatgtgtgcaacatcctcaaatccccaccactctgtgcaacctccccaaatcccccccaatctatgcaacctccccaaatcccccccaatctatgcaacctccccaaatcctccccactctgtgcaacctccccaaatcccctgctttgtgggcaatgtcacaaaatcccccggtgtgtgcaacctccccaaatcccctccactctgtgcaacctccacaaatcccccacactctgtgcaacctactcaaatccccacactgtgtgcaacctcctcaaatcccccccactgtgtgcaacctcctcaaatccccccactgtgagcaacctcctcaaatcccctcactgtgtgccacctccccaaatccccccactttctgcaacctccgcaaatacccccactgtgtgcaacctcctcaaatccccccactctgtgcaacctcccctatccctcccactgtgtgcaaccgccccaaatcccccaactatatgcaacctactcaaatccccccactgtgtgcaacctccccaaaacccccactgtgagcaacctccccaaatcccctcactgtgtaacctccccaaatcccctcactgtgtaacctcccaaaataccccccgtgagcaacctccccaaatccccgcactgtgtgcaaccaccccaaatcccccccactgtgtgcaacctcctcaaatcctccgccactgtgagcaacctcctcaaataccccactgtgtgcaacctcctcaaatccccccatctgtgtgcgacctccccaaatcctcccagtgtgtgcaacttccctaaatccctccaactgtgttcagcttccccaaataccaactgtgtgcaacctcctcacatccccaccactctgtgcaacctctccaagtcacccctactctctgcagactccccaaatccccccccaatctgtgcaacctccccaaatcccacccaattgtgggcaaccacacaaaatcccgccactgtgtgcaacctcaccaaatttctcccactctgggcaacctccccaaatcccccccactctgtgcaacctcccaaaatcccacacactgtatgcaacctcctcaaatccccatactgtgtgcaacctcctcaaatcccccccactgtgttcaacctcctcaaatccccccactgcgtgcaacctcctcaaatccccccaatgtgagcaacctcctcaaatccccccactgcgtgcaacctcctcaaataccccactgcgtgcaacctcctcaaatccccccaatgtgaggaacctcctcaaatcctcccactatgtgcaacctcctcaaatctccccactgtgtgcaacccccccagatctcccccactgtgagcaaaagcacaaatcccccactgtgtgcaacattcctcaaatccccgcactgtgtgcaacccaaccaaatctcacccactgtgagcaaacccccacatccccccactgtgtgcaacctcctccaatccccccactgtgtgaaacctccccaaatccccccaatgtaggcaaccccccaaatctcccccacagtgagcaaaaacacaaattcccccactgtgtgcaacctccacaaatcctcccaagtctgcaaccccccaagtccccccattgtgagcaaccaccccaaatcccgccactgtgtgcaacctcctcaaatcacccggtgtgcaacctgctcaaatccccccactgtgtgcaacctcctcaaatctctcaactgtgtgcaacctcctcaaatccccccttctgtgcaatttccccaaattccaactgtgtacaacctcctcaaatccctcccactctttgcaaactccccaaatcgccccactctgtgcaaccgccccaaatctaccccagtctgtgaaacctccccaaatcccccccactgtgtgcaacctcaccacatccaccactgtgtgcaacctccccaaatcccccctaccttgtgcaacctccccaaatcccacccactctgtgcaacctccccaaatcccccacactgtgtgcagcctcctcaaatccccccactgtgtgcaacctcctccaatccccccactgtgagcaacctccccaaatcctcctactgtgtgcaacctcctcaaatcccccactgtgtgcaacctccccaaatcctctccactgtgtgcaacctcctcacgtcccccactgtgtgcaacccccacaaatcctcccagtgtgcgcatcctcctaaaatccccccactgtgagtaacctcctaaaatccccccactgtgagtaacctcctcaaatcccaactctgtgcaacctccccaaatctccccagtgtgtgcaacttccctaaatccccccaactgtgtttaacctctccaaatccccccactgtgtgcaacctccccgaatccccccactgtgtgcaacctccctgaatccccccactgtgtgcagcctctccaaatcccccccactctgtgcaacctcctcaaatcccccccactgtgtgcaaccgtgctaaatccccccactctgtgcaacctcctcaaatccccccactgtgtgcaacctccccaaatccccccactgtgtgcaacgtccccaaattcccccactgtgtgcaacctccccaaatccccccactatgtgcaacgtccccaaatccccccactgtctgcaacatccccaaatgcccccactgtgagcaaccttcccaaatccccccactgtgtgcaatctccccatatccccccactgtgagcaacctccccaaatcccacttgttgcaacctccccaaatccccccactgtgagcaatctccccaaatgccccaccgtgtgcaacctcctcaaatcccccaccactcagagcaaccttctcaaatccccccaatgtgagcaacctcctcaaatccccgtactgtgtgcaacctcctatcacccccactgtgtgcaacctcctcaaatccccccactgcgtgcaacctcctcaaatccccccactgtgagcaatctcctcaaatccccccactgtgtgcaacctcctctaatccccccactgtgagcaacctccccaaatccctcccattgtgtgcagcctccccaaatccccccgacgctgtgcaacctcccaaaattgcccccactgtgtgcaacctcctcaaatccctcccactctgtgcaaactccccaaaccccccccttgcagcctccccatatccccccaactctgtgcaacctcccgaaaacacccctcactgtgtgcaacctcgcccaatcacgacactgtgtgcaacctccccaaatcacccccactctctgcaacctccccaagtctcccacactctgtgcaacctcctcaaatccccccactgtttgcaacctcccaaaatctccctatgcgcaacctcgcaaaatctcccccactatgtgcaacctcctcaaatccccccactgtgtccaacctccccaaatccctcccactgtgtgcaacctcctctagtcccccactgtgtgcaccccccaaaaatccccccactgtgtgcaacctcctcaaatcccccgccagtgtgagcaacctcctaaaatccccacactgtgagaaacctcctcaaatccccccaagtgtgtgcaacgtccccaaatatccccagtgtgtgcaacttccctaaatcccctaaactgtattcaacctctccaaatccccaccactgtgtgcaacctcccgaaatcccatcaactgtgtgcaacatcctcaaatccccctcactctgtgcaacctccccaaatctcccccactctgtgcaacccccccaaatcccccccattgtgggcaacgtcacaaaatcccacgatgtgtgcaacctccccaaatcccccacactctgtgcaacctccccaactccccgactctctgcaacctccccaaatcccccacactgtgtgcaaccttctcaaatccccctactgtgtgcaacctcctcaaatcccccccactgtgtgcaacctcctcaaatcccccccactgtgtgcaacctcctcaaatccccccatggggggcaacgtcctcaaatcccccgactgtgtgcaacctcctgaaatcccttcactgcgtgcaacctccccaaatacccccactgtgtgcaacctccgcaaatccccccactgtgtgcaacctccccaaatcccccccactctgtgcgacctccccaaatccccccactatgtgcgacctcctcaaatccccccagtatgtgcaacctcctcaaatccctccactctgtgcaacctcaccctatctttcccactgtgtgcaacccccccaaatacccccactatgtgcaacctcctcaaatccccccactgtgtgcaacctccccaaatccccccactgtgtgcaacctccccaaaaccccccactgtgtgcaacctccccaaatcccccccactgtgagcaacctccccaaatccccacactgtctgcaaccaccccaaatcgcccccactgtgtgcaaccgcctcatattccccccactgtgtggacccttctcaaatcccccctaatgtcagcaacttccctaaatcccccaactgtgttcaacctccccaaatccctcccactgtgtgcagcctccccaaatcctcccgactctgtgcaacctcccaaaattgcccccactgtgttcaacctccccaaatccctcccactgtgagcaacctccccaaatccctcccactgtgtgcagcctccccaaatcctcccgactctgtgcaacctcccaaaattgcccccactgtgtgcaacctcctcaaatccctcccactctgtgcaaactccccaaacccccacactctgtgcaaccgccccatatcccccccactctgtgcaacctccccaaaacacccctcaatgtgtgcaacctcgcccaatcacgacactgtgtgcaatctccccaaatcccgcccactctttgcaacctcgccaaatcccccccactctctgcaacctccccaaatcacccccactctctgtaacctccccaaatcacccccactctctgcaacctccccaaatcacccccactctctgcaacctccccaaatcacccccactctctgcaacctccccaaatccctcacactgtgtgcaacctcctcaaatcaccctactgtgtgcaacctcctcaaatcacccccactgtgtgcaacctcctcaaatccccccactgcgagcaacctcctcaaatctccccactgtgtgcaacctcccaaaatctcccctattgtgtgcaacgtcctcaaatcccctcactgtgtgcaacctccccaaataccccccactgtgtgcaccttcctcaagtcccccactgtgtgcaacccccacaaatccccccactgtgcgcaacctcctctaatcccctcactgtgtgcaacctacacaaatgccccccacagtgcgcaacctcctcaaatcccccaccactgtgagcaacctcctcaaatccccccactgcctgcaacctcctcaaatccccccactgtgtgcaacctcctcaagtcccccactgtgtgcaacccccacaaaactcccactgtgcgcaacctcctctaatcccctgtgtgcaacctccacaaataccccccacagtgcgcaacctcctcaaatcccccaccactgtgagcaacctccccaaatccccccactgtgagtaacctcctgcaattgccccgcactgtgcaacctcctcaaatcccccccacagtgcaaaacctcctcaaaacccccgccactctgagcaacctcctcaaataccccactgtcagcaacctcctcaaatccccccaactgtgtgcgacctccccaaatcccccccacagtgtgcaatctccacaaatccccccccactctgtacaacctccccaaacccccccaactgtgtacaacttcctcacaaccacccactctgtgcaacctccccaaatcccccactgtgagcaaccttcccaaatccccccactgtgtgcaatctccccatatccccccactgtgagcaacctccccaaatcccccacactatgtgcaacctcctcaaatccccccactctgcacaatctccccaaatcccccccactctgcgcaacctcctcaaatacccccagtttgcaacctcccaaaatctccctatgtgcaacctcgcaaaatctcccccactatgtgcaacctcctcaaatccccccactgtgtccagcctccccaaatccctcccactgtgtgcaacctcctctagtcccccactgtgtgcaccccccaaaaatccccccactgtgtgcaacctcctcaaatccccctactgcgagcaacctcctcaaatctctccactgtgtgcaacctccccaaatcccccactgtgtgcaacgtccccaaatccccccactgtgagcaaccttcccaaatccccccactgtgtgcaatctccccatatccccccatatccccccactgtgagcaacctccccaaatcccccacactatgtgcaacctcctcaaatccccccactctgcacaatctccccaaatcccccccactctgcgcaacctcctcaaatccccccactgtgtgcaaccttcccaaatccccccactgtgtgcaacctcctcaaatccccacactgtttgcaacctcctcaaatccccccaaatgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatcccccccactctgtgtgcaacctccccagatctcctttctgtgcaacctccataaatccaaccaaatgtatgcaacctcctcaaatccccaccactctgtgcaacctccccaaatccccatcactctgtgtaatctccccaaatcccccccaatctgtgcaacctccccaaatcccaccactgtgttcaacctccccgaatacccaccactctgtgcaacctccccaaaacgcccccactctgtgcaacctccccaaatccccccaactgtttgcaacctcccaaatcccccccaatgcgagcaacctcccaaatcccccgtgtgcaaccccccaatctcccccactgtgtgcaacctcctcaaatcccccatcactcagagcaaccttctcaaatccccccaatatgagcaacctcctcacatccccctcgctgtgcgcaacctcatcaaattttcccactgtgtgcaacttccctaagtcgtccaactgtgttcaacctccccaaatccctccaactgtgtgcaacctccccaaatccgcccccaccctgtgcagcctcacaaaattacccccagtgcaatctcaaatccctcccactctgtgcaaactccccaaaccccccacgcagtgtgcaacttccccaaatccctcccactctgtgcaacctccccaaatccctaccactctgtgcaacttccccaaatccgcccacactgtgcaaccgcaccaaatcgcgccactgtgtgcaacctccacaaatcccgcccactctgtgcaatgtccccaaataccccccccactctgtgcaacttccaaaaatcccccacacagtgtgcaacctcctcaattccctctagtgtgtgcaacctcctcaaatctcccccactgtgtgcaacctcctcaaatatccccactgtgggtaacctccccaaatcccccccactgtgtgcaacctcaagtcccccactgtgtgtaacccccccaaatcccaccactgtgcacaacctcctctaatctgttcactgtgtgcaacctccccaaatccctccccaatgtgtgcagtctcctcaaatcctccgccactgtgagcaacctcctcaaatccccccagtgtgtgcaatttccctaaatcgccgcaagtgtgtacaacctccccaaatcccccccactgtgtgcaacctccccaaatctcccccactctgtgcaccttccccaaatctacctaactctgtgtaacctcctcacatccccccactctgtgcaacctccccaaatcccccccccccccattgtgggcaaccacaccaaatcccgccacttgtgcaacctcatcaatttccccccattctgtgcaacctccccaaatccaccccactctgtgcaacctcccaaaatcccccatactgtatgcaacctcctcaaatccctgtactgtgtgcaacctcctcaaatcccccccactgtatgcaacctactcaaatccccccactgtgtgcaacctcctcaaatctccccactgtgagcaacctccccaaatccccctactgtgtgcaacctccccaaatcccccccactctgtgcaacctccccaaatcagccccactccgtgcaacctccgcctatccctcccactgggtgcaacctccccaaatccccgtgtgccacttccccaaatcaccacattgtgagcaacctccccaaatccccccactgcgaagacctcctcaaattgccccgcagtgtacaacctcctcaaatcctccctcgctgtgtgcaacctcctcaaatccccccactctgtgcaacctccccacatgcccccagtgtgtgcaacctcccgaaatccacccagtgtgtgcaacctccccaaatccccccactctgtgcaacctcccgaaatccccccaactctgtgcaacctccgccatccctcccactgtgtgcaacctgctcaaatccccaaactgtgtgcaacctccccgaatccccccaactttgtgcaacctcaagtccccgaatgtgtgcaacccccccaaatcccgtgtgcaacctccccaaatcccccacactatgtgcaacctcctcaaatccccccactctgcacaatctccccaaatcccccccactctgcgcaacctcctcaaatccccccactgtgtgcaacctcctcaaatccccccactgtgtgcaaccttcccaaatccccccactgtgtgcaaccttcccaaatccccccattatgtgcaacctccccaaatcccccaatctatgcaacctccccgttccccccaatgtgttcaagccccccaaatccccccactgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatccccccccccactgtgtgcaacctccccagatctcctttctgtgcaacctccataaatccaaccaaatgtatgcaacctcctcaaatccccaccactctgtgcaacctccccaaatccccatcactctgtgtaatctccccaaatcccccgcaatctgtgcaacctccccaaatcccccccactgtgtgcaacctccccaaatcccgccactgtgttcaacctccccgaatacccaccactctgtgcaacctccccaaatcccaactgtttgcaacctcccaaatcccccccaatgtgagcaacctctcaaatccccctgtgtgcaaccccccaatctcccccactgtgtgcaacctcaaatccccccactgtgtgcaacgtcctcaaatacccccactgtgtgcaacctccccaaatccctgccactgtgtgcaacctcaccaaatccgtccactgtgtgcaacctccctagatcccccctatgtgcaacctccgcaaatacccccactctgtgcaagtgccccctatttccccaactgtgtagcaacctccccaaatccccccactgtgtgccacctccccaaatcccccaactgtttcgaaccacctcaaatccccccactgtgtgcaacctccccaaatcccccccaccctctgcaacgtccccaaacctactctgtccaacctccccaaatcctccactctgttcgacctccgcctatcgccctactgtgtgcaactccctcaaatccccccactgtgagcaacctccccaaaccctcccattgtgtgcaaactcccaaatctccccactgtgtgcaacctcctcaaattcttccactctgtgcagcctccccaaatccccccaactctgtgcaacctccgcctatcccccccagtgtgcaacctcctgaaatcccccaactgtgttcaacacccccaaatccccccattgtgtgcaaactcctcaaatcaccccgctgtgtgcaacatccccagatcccccccaatgtgtgcaacctccgcaaatccccctactctgtggaacctcctcaaatcccaactgtgagcgacctccccaaatcccccaactgtctgcaaactccccacatctccctcactgagtacaacctccccaaatccccccattgtgagcaatgtccccaaatccccccactgtgagcaacctcctcaaatccccccactgtgtgcaatctcaaatcccccccactgtgtgcaacctcctcaaatccccaccactctgtgcaacctgcccaatttcccccactctgcaacctcccgaaatcccccgtagtgtgtgcaaccttctcaaatccccccactctgtgcaacccccccaaatccctctactgtgtgccacctcaagtccccccactgtgtgcaacctcctcaaatcccccacactgtgtgcagcctcctcaaatcctccccactgtgtgcaacctcctcaaatccccgcactgtgttcaaccttctcaaataccccatactgtgtacaacctcctcaaatcccccctgcagggagtggcttctccctgtgaatctctcctcccttctttgcccagaagcatgtctcaattagtaagagtgcagttaatatttctcatcttaaggtggtgctccgacctgatacaaaggaaagcgggttgaattcagaggcacgggcataccctgtccttgtttctaaagtgttcatgaagaagatcgaattcaaatggtgaaatatccatatatgcaattgtatagaaaagtcaggattatttgacaaggattgtttttgatgcttttatgcaattcagaacctcaatgaatatagaaaataatttaaaaagacataagagctctctagattgaaataagcatggtgcttataaaacaatggtgaacagtgaatgccaattattttaatttaaatttctattatgcagcaaattcataaaatggggaaagtcttttttcaacatttccaagacatgctctgttaagacatggttgcttcaggtggcttttacttgggatattgagaggtaaggcagagtggtgatggttcaggctgaggagggcgagggctgccataacaaagaaccacacgtttggtggcttaaagcaacagacgttgatgttctcacagttctggagaccagaagagcaagtcacggtgttggcagggctttgctccccccgaaggttggaaggacgaatgcgccttgcacatccagcctttggtgccctgctggtgttcactggcattgcttggcctacagactcctcacgccaacctctccctctgtctttacccggccttctcccctgcgtgtctgtattcaaatgcccctattcctataagggcaccagtcctgctggattccaggttccaccctaccccagtatagactcaccctaactaattacatctgaaaaaaaccttacttccaggcaaggtaacattcccaagttctgggtggatgtgactttgaaatgattatcaagtagatccagttccgtttacagtaatgagcagacagtgaatgagaaattaatgtgctttcacatcgcacgaacacctgaccttcactgaattttaatagaagctggcattggtgctaactccttacagactttatgtcagtgtattctcactgaaggaagttgctattttatcccactttacgaatgagaaaactgagatgcggagaggtcaccaagtcaaactcaagcgacaccccagcccccctcggtgatcaggctgaagcgatgactaaatgccatttgctcctaatgacaccgtcacaagcactgaagccaccaaggaccgttgggcctgtacagaggagaggcagactcaggccctccccactgacaggagggctgtcttccatgtacacctaggtcggagtccgcaagggtggggcggtgacggtgcactggactttgctggcggtgctggaatggctatgcggagggcgctgtggtgcggggactgcgctccccaggaggacctcgggagttgtttgtttgtaggtattacagtattgtctaacgttgccgcgttgacacagggtcacgggaagccacctccagggcctgtggtcctcttcaggcaggcggggcggggaatgctcaggaccggtgatgatggtgccatgcagagttcagggatgaatgaccaccaaggcaagggaaggagtccagcagctcagtatttggggaatgggggcgggggcaggtaaaaacgcagaatcaagggaaacaaacagctggaaaatatagtagctgttaagttctgatggaaaagctgttttgtacttacagttaaatcccacagtatttgtgatgtatttccgggtaacttgctcttccctcctcaaaaggtcccagcctcaccagagcttcccttcctgcaccggccccagctctccacgcctcccagagaccagggggcctccacccttgctcctctgggacggcgcttcctccccctcatctccaggtcggggctggggtcttcaggctcaggttgaagatgctgttgggccctttgcctgtacagggatggcgcccgacccaggaaaagcctaacgttgtctgtcatttggatgcgtctcttggcagtgactggggggaaatcctcactgcagcccgcgtcccttgcatgattgttgtaagaaagccccagctcagctgcgtggagacagggtcctcttggctgcaaattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtggggaggtgctggtcacaggcacaaagtctcaggcaggaggagggcgcctcaggtctgctgcacggcatggggcgcacgcttcctcataatgatcgcatgtttcaaaattgctaaaacaataggtttttttttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 1359 - DNA, 129268 bp, Homo sapiens; identical to SEQ ID NO: 1358

SEQ ID NO: 1360 - DNA, 129268 bp, Homo sapiens; identical to SEQ ID NO: 1358

SEQ ID NO: 1361 - DNA, 129268 bp, Homo sapiens; identical to SEQ ID NO: 1358

SEQ ID NO: 1362 - DNA, 5547 bp, Homo sapiens
tttatttttctactttcttttaatatcattttttaaagttggtaagcagctagacatcatttagaagcagacgggttaaaatagacaagaaatagcaaagacacatccttcacatcgtacagaactgtattagtatccaccaccaccatcacaggggagggctagctgtcactggggtcaggagtactctccattattgtgcaggggaccagacagcatttaggtgtgacgatgtcaaactgagtggacatagagagtgccgggatcaaggtctacagttttggctctagacttgcgtgagggttggttactcttaatctcttccaggctgtgctggatcccatagccgaagtagatagcaaagcctagtggggaaaggtagctgtgaggtgggggtgtaaaggcttcataggtttcctacttgagaccaagagggaaaggagctgggctaggacaccaaagaagcctactcttcccaagtggatacctaccaatcagcatccagaccccaaatcgggcccaggtaccagctgtcatctgcatcataaggtaaatattcacaaagatgctcattagtgggaggagaggcaaagcaggcacctgaaaacaaagtaaaatcttctttgtacataccacaggttgacctagaaagagatccctatcctatgcaggccagaaaagggtgagtccaactcttacttgtcctctgcatttcagtagctgctcatttagcatacctcatgagactccaagaatatgcagtttgggtaaatggaactggaaaggaactaaagagggtcagagaagaagtctttggcctaggtacctcctatatcttccctttcatgttcaattaaagaatatctatgaactttattagacctcaagatatctggagcctattctcccaagatgggctggcaaggaaaaaagacagagttcatttaccttaaagtgaaggggagtggaactctgtggctgtctccagatgaccacaatgatcccaataatgagcagcaggagcagcacaaccactgcagtccacagcaggtctccagaaagcaatggaactgaccactgggccagcaccaggcaaagagcagtcagcaggacagcttcaaaggtcaagttgagagacatcaaaaccaactcttaagaccaacatgctaagacattagaaaccctgttccaaggagagtcgctctctctctagttcttcctcagccaccaaatgccacacacttcgacccaatcacgctgatctcagagccaccccagaaaaattccactgctcaccaagcaatgaggaacaaacatagacaatttggccagagagtggagtggggatggagttgagtgggaaaaatagtccccatagggtcaacttctctgattcagtagttattgcctcctcctgcaactccacttcttccccagtctttgtctcctgatcaggttgatacctgaggcaaaagtaagatggcagtattaagaacaacctttactcactttatcatcttctcccaggcagcttaaccttcctcatcaccattaagggaagttctttttggcagggtgagatacccagattcctcaaagaaagttggaataatgaaggcgaaggaggaaagaggagcagatctccatcattcctcatccaagaataaaaatccaaatcacagtatgcagaggaagagtctcacctgaggatgagaacacaaatcgacaccagggagtaagcaagcagggtcccaattgacatgaggtccacaagatcagtgagtttgaagaggaatgccatgaatgctaaaattaataggcaggaaacaagaaatgagagaagggagtggcaaagttaaagaagttggcgaaacaactaagggaaggggaaagagggtctgttacctgcaataatgccagagaccacggtggctatgattggggtgcgtgtgccggtgtggatccgagcaagtacacggaacaggaggccatcctctgccatcgcgtagatcacccgaggcatggggaacatggagcccaggaggctggagaggagaatgcccagggtggcatgagttgactgggatctctcttcccaagactgtatgtttaaagagtctccactttcccctcacagcccttttaaggggtattctctggtactgaatgctataacctgagactctgacagcagaagaaaacaaacatttgatactgacctggtagaaagagcacagagggagccaacagccacaacatagcgggcaggagcccatccaatgtagagaaatgcctcaggcaaagggctctcaggctgaagctggtagtaaggcatcatcagggtgagtgcagaagagacagcaaaatacgccaaaaagcagacagacagtgagatcacaatgcccatcgggatggaacgctggggattctgggcttcttctcctgaaggaagggcgtaaggttctaaattagggaagcaggcccactcctctaccacccccagtctgcatacagcctgggcacacactgtgcccaagccccaaacagaatggaatgactgtgttaccagtggtagcaatacagtcgaaaccaacaaatgcatagaaacaggtcgctgctccacggagaattccctcgaagccgaaaggcacaaatcctccagagcccagaggacccaagctagagtggaagaagggttggagaaggtaagggtgtgttcagccaactctgtatcttttctctaatgccaaaccagttagctaggtcttcaaagcccagcctcccattttttcccatccccatccagaatccttcagcagatccccttcttccccttcattttcccagctctgcagctcctaagagtgaccatctaacctataggtgtcattgagttcagccatggccaattcgtagtcctcttctgtgagcttccagttgtgcacgtcccccttaacgaagccagagatcatgacgaacccaagaaccaaaaggttcacgcctgtgaacactttggtaaccagggccgactcactagccccgagagccaacaatcctgtgggagaaatgcattcaggactcccagaaagtcttcagtccaagctttgtttccctgcctctaggttccttcccagcttttcttcttccccaccattatcacctcccttaagcctttctcaggcccatcccccatccttatccctggccccaaggactagcccctcctggcccaacccccaccattataccctgctctttgcctcaccagtgagcagcaacacgaggcccaaagcaaagaaatctggatattctgcaaggacatggggcacgtgcagtgcaatggacccctgcagagtcttagagatgtggttcccaatcaggttgtcaaaagcagagctccaggcccgggccacactggctgtacctggtgtagcagagagagaaacatgtggccaagttcccttcttcccagaccccaggctcacacaagtccctgcctttttcacctattcttacttttgttttgttttgagaccaagtctcactctgtcacccaggatggagtgcagtggcacaatctcctctccctgcaacctctgcctcctaggttcaagagattctcctgcctcaacctcctgagtagttgggactacaggtgtaagccaccctgcgcggctaacttttgtatttttagtagagacagggtttcaccaggttggccaggctggtcttgaactcctgacctcaggtgatctgtctgcctcggcttcccaaagtgttgggattataggcgtgagccactgcacctggcctattattactttttaagaaccaaaaccattcacttaattaaggaaaccaggacggagatggatagaatgagcaatttctccacaccttcaacacccccccccagacccccagcaaacccgcacatttagggagattgaggtcctgtgaataatataaagaatacttccacccagatttcctgaccaaaaacccctttgctggctgtgcagttccctccctcccccaccatatctcaccaatgacataggagaggatgaggttccagccagtggtgaaggcccagagttcacccacagtgacatagctgtagagatatgccgaaccagaacggggaacccgggcaccaaactccgcatagcacagcccagccaacacagaagacagggcagccaccaaaaagcagatcacaatggatggccctgctttatctttggccacctcgccagctaggacatacacgcctgcacccaatgtgctgcccacacccagggccactaaatccagggtgcttaggcatctggcaaggcgagtctcagccatgcctgactccagtgtacgtctgcgtaccagcttttgaccaaatctgcgaaatgcttgccacggcatcctagcaggaattgaagaagatgatctggtgaaaaacaagacaaaaacccctcgacagggctcattatccctaaactctgaaagcgaattacaagaccccctccaccaagcaaaggagctattgggaaatgaggacggggatatggaagggacaaaggcaagtcactttacctctaacctcagtttcttcataaacaagtaggaattacaataccttacaaggtttttggaagggctaatttcagaaatggcacgtgaaagccccctgaagtagagtggctggcgcctagtaagtgctcaatcaatattaggtctctttctcttgccagaaactgatagggtttatcctaatctcaacccaggaatcttgaaacctaatgtgtcagttccttggcctgtggctatttgggaattaaacagagctccacccaggggcttcccccggggcttcaaacagacacagcccccagaccccccagagggagaggggaccaacctcgctgcagattaaaagtgagcaccgactcaattccatccctcctcaccaagcccacactgctcaactagcgcagctgtcgcccaggggagtaagcaaatgttcccctacttcctcccaagccctgctaggctgacctgcaagcatcaacagcgaggcggggcttcgacatctaaagatttggagatgcgcccccagaggggccccagggcagcccgagattgctcgcactctcctctcagcagagaggaagggttccacccgatgccccccgactcaggtcccagattttcctgcccccatctagaaatggtttggagctggggtggagacgggagccctaactcccggggcgggggtctcgccagcaacaggtcacggccccgttgatgcaactgcatgccatggttgccagagaatcctaggtacgcccggaccctcgccgtcccccctccgacacacgtgtgggtccccaacgcttaccagagagctgttgcaaacctagggagcacagagtcttggactgggctcggtgaggcggagttaagccgagttgggttggagctgccgagttcggccgctcaggcttcaaagctgcggcttggggtcgttgcgcgccaagcgccccttat

SEQ ID NO: 1363 - DNA, 5547 bp, Homo sapiens; identical to SEQ ID NO: 1362

SEQ ID NO: 1364 - DNA, 49918 bp, Homo sapiens
gcacattccttcctcacgagtcccaggtccagctttattacctaatacaagtccaacctctggaacatccaaattcgctgttccaaagtttaattaaaaacacaatttacaaatatttaatatcttctgaaaagcatttctaagttaagaatgaaaaagtatgtacataatatataatcaaataccaggcagcctcaacttccaccaggtccacactcagcaacatccgtctttttaggttcttcagtgtctgaaagaaaaagacatcacttaattcaacattgtttttaccttttaattaaaaaggggacatgaaagtcaagctgccatccagaagcataactgctgagagcccttcttcaccacatccaaggctgaagactacgcgcattatcaggtgatcattgtggctcttctgcacacaggaaatctttattaattctttagacaagataaaaagaaaactaagagtagtttatacattaaaaacagataaatgttccttttacagttgacccttcttatccatgggttccacatctgcagattcaaccaactgccaattaaaaatatttggggaaaaaacccaattaaaaaaatacaacaaacaatgaaaaaaatataaaaaatacagtctattaactacattctatgaagtatataagtagagatgatttgaagtatactggaggttgtgtgtagggtataggcaaataccttttatgttagggacttgagcatctacagattttgctatctttgtggggtaaataccaaatccgaggtcctgataccaatctcgggcagacactgagggatgactatagtcaccatagctttctgctttcccagagaaaacagggcacgtaccttctgtcaaatccacaaagttgttttccatgacgggggaaggaatggaaatccccattgcttttcgaactccatacgtgcttacgatatcacctggagttacttgctgtgcaagttctttaagattattggtcacttgttcagctaaaaagaaaaacaaagttccagatactaaagcatggttcctttagatagaggcatcccaaagaacagtaaatgtacacatgcaaagaaaacaaaacaaaaaaactgtccctgggattcacatcagcattactctatagtggcatcaccactgtactcaagaagttttttctttgaagcatcccgtgactctcctcttatgggaggcaaaacataccaagatgcatttctctgtatgagggacccaagagacagatcatgttcggagggggtctggtgctcaaacgttcattctgggcttcctggagttccctgagcaatctggtggtctcatcaagtttcttctggaatatttcagcttctgtgtggtaagaaaacagacacacttctgtttgatcttgtgcagtaaaccgaatcctaggctctagggctttgctaattattggttagccttctcccttcaaaagagtaatccgcttgaaatgacatcaacacgccatacccattcatttaacttggtaagccaagatcttcctgtggtgaatggctatgttaatctgtacttatgagacatgaaatcttgactgcctacatcatgcagtgtttcaatcaaaccctctggagacacttaccttcagagtcaaaaacttcaactggaacgccaaaatttgttactgctttcagcgctatgagcctgtcttgagtactggagtccaaacgccctggtggctctacttctgtaatctgcttcaaaaggaaaaacaggcaattactggcgcttgctaagccacagcagtgttaactagaaattactcagatggcatgtatttacaggcaaagttattctacctatttactatggagtcctaattttgatgcttacagaaaatgaatttccagaacacccttttaaaatgctattcccaaatcttggcaaaaacaggtattcaataaatccatacttctgtgaaatgtaatgatgtatcttatacaatttatatcatttgtttagtatggcaactattctaaagatgaagtaatgagagccttgttgttgcttaaactgtgaagagcttttggtgatgacaatgccttgtgttttcgagattcaaagactatttcatatttcagtccatctagtccgtatacttgcattcctattgatacacttcccgggtcttctccaggcctccaaactaggctgtcagtattgcatgagagaaacaaaatcttaaaaaggatggagttggcctggcgcagtggctcatgcctgtaatcccaggacttcgggaggccgaggtgggcggatcacctgacattaggagtttgaaaccagcctggccaacatagtgaaaccctgtctctactaaaaatacaaaaaaaaaatttagctgggcatggtggcatgcacctgtaatcacagctactcgggaggcagaggcaagagaactgcttgaacccaggaggcggaggttgtagtgagccgagattgtgccactgcactccagcctgggcaacagagcgggactccatctcaaaaaaaaaaaaaaaaaaaaaaaaaaaaagatggagtttttattttcagaatcattaagactcaggggtttccataacctcaacattactttttaggaatagatcaacccagatattaagcaatcaaaagctaatggttccatttatactatggtatggctctccaactctaactccattgatccacctgatttctctacctacatatgggctaaaaacttgtgggggagaaactgtataattgtgcaacttggcactgatatgcatttatggtttgccatttcagctaggccctcacaactctactcactaacctttttccttcttacccaatgggccttcccattctcaagacttctcttactccccttattttccatttaaatatttcttgtaaagtgtaaaataaaatcacctccatttcttttgctgtgtcaagtgtcctagtatggccttcatcttcaggcaatgactataaggatgaagaaaaacagctttttaggaaaacacatgaaggcgaatatcaaggaaaagagaaaactgtcaggagtttcttggcaagagaaaatgaatacaaatatggactactggaatataatttttcaggccaaaatgactaaatataattattagcattttgagaggattctgtgagctggggtacttattactggtgatgttatttccatgcctgatcaaaagctatatacatgtttaagaaggtatttggtaaataacttataaatatgtaaataaatggtatctgtttttatcagaaaaatccctgacgagaagacaggaaggagttctagggattactgtgcatgaacacagcaatattctcagatagcagaggattactgtaaaataatcaaatgctacagagaatgtgaaagcttcccaatcttgctcttcagagctaatgcacccaggaacaagagacaaatatatcatggacatcaatcaatgatgtcatctttctttgaaaggttgtgagttatttaaccaattcccaatttctaaaaattataaacaatgtaaccttatatgtaacttttgtattttttctagaataaattctgagaagaggaactgctatattgaaggacaaagacacttgacattttgaaacacattgccatattcaccaaatgaaaaatattcaattttcgttagactattaattcattcagattaattgatgaggatatggtaaaaaaatatgtattttttaaattgatgtaaaatttcattttttaggtcatgtgatgaaagcagtccaagtgcggatattttacagcagtcatcgttgggcctgaccgaggcactaacctcagctctgctgacaggtcacccagcaaccatatgtgcagttgtgagcagggtaccaggcactacagtcacagtcaccattaagagttagacctccaaaagacacagggttcctctaactattgtgacaggaacgttctggagatcaactctcttctgtatcagtaggaacattttctggttctaatccttaagccaaaactctgaatgattccagattaccaactatctccaactgaactagagatagcttacaaatgttaataaaatagcaatgaggaagctttttactttttaacttgaggttcctcccgatgtgctattactgcacgaggaaaagccattccctatcattttagccaacttagtttcaggccagtgagcaaaactttccttttttgttagaggacacaatgcccactgacttctgagttgtaaaccccatttttgagtcctacattcccaagatgaggagataaggataacgctcaggccctcacagatcctggtagctaaattactcctttccgtttattgtccacccgtggcctccagccgggctgggctgtctttcagggccacagagttcagctgtcatacttgttaatcccatggtttcattatactgaatgactaatgcttgagagtcgataataaattaccctgttttcattagcagtgttcttaccatctccatctcttgtagggtcctggaatgccctccttttgttaaaacatccagtaaactatctgccatgacatacggataatcttggcacgtggccaaaaactcatggatgctgcaagagacagttaggaaagtctcacataaatcacctccactggctttatcctcccatcagagccaactgtttccactagatgtcctcggttatacatcatgacatcaaatttctgcctagacacaacatggtatctacatattaattagcaataacattatcatgagataatatgaagaacacagtaaaaataaaacgttccaaagaaaaatgaaacctcagtgacgggtgcaggctcagtccctggatcttctgctccccgccccctcacttcctgtctgcagtgatcaccttcacctcaggactttcatatgggatcaaaaaactctcaaaagttacacctccagtttggaccacaccctttggtgctccacatggaagtctaacagacatctcaagcttaaaatatccaaaattgaaatgctagatcttccccccaagtaatgttccaaagcttcccccttctcggtaaatagcaactgcagtcttccaggctcagtgtgcaaaccctggagtaagcctcggcatctctctctcacatcccacttcaatcagtaaagaaatcctactggctgatgactgagcccttcccagaacctcacctgctactcccccggtccatttctcatctccctacttctgcccttgcctctctacagtctattctccaagagtagccagggtgatcctttaaacatcataatctggaccgggtcactcttctgctcgcaatccaccagtaacttccatctcactgagaatgaaattccaagtgcttataaagacccactctcatcaacgccctccctggccatgtgcctgcactcttctgcttcttcctgctgttctcaagtatgttgggaaggctcccactcaggccctctgcacagctcctgcactgcctggaacgttctttcaggtagcagccttgcttgcttcctcacctccttcagtttttgctcaactttcccttttgtaccagacttatctgaccgatttaaaagtgcatccctctcgtagccccagcactactctctccttctctgctgctttacctttctccaaagcacttgtcatcatttgacaggagggcatgggcctttgccagtgttgttcccctgtgcaatccctatttgtggaatgcatagatgcatgatccagaaagaattcattcaggctggtgaggtctaaaagattaaatggcttgatctgaaaccacagtcaacttcggacttaaggacctctaccttgtaaaaacaacaacaaccaaaccacacttactaatgtaaaagtgaacagattccctctttgtgagaaaagcaggggactggtgaatctacagggttaatttcttatatgtaatgaaaattagcaaggtactactgctaagaaggaataatatccagtaaactactgccataacccaagctcagtgtcccatcctgagccagaatcctgctaagtcaggatggatctcattatgttgatgggatccaaactgctcagcatcctaaacaggaacacagagatgatcttcccacagaaacatgcaataaagaatggttgagtttaactgcaatggtctacctggcatgtgattggtcaaaaaggcttttatgtgggctgcctatggaatagagccatcctatcctgcctcctttcttggggaaaatgcactgtaggttcccaaactgatcaagtttggaccataactcactgacacacaacatgttataagacagcagatggcacatcaacgttttgaagtaacaagttcctacactttagtactggctgaggtacagtctctttaaaaatatattttttaaaaattaaaatactgcagatgctactatcagggagacatgctctctctctccactaaaggataatagtaactatgaatccattattgtcagcttaaaaaaaaattactgagcacatttttttttactactcggccagctttgtcagtctatccacaaatcatgtatgtactttaatgtttttaaacaaatgtaatcagaatattaactggaaactcacctgaaatcacttggaagatcagagtcttccccataggttgaatagattaaatcagaatcatccttgctgatatttgcaaatgtggagtcataatgcggtgcataagaactgtagggcccataattcaaatataacactgttgaaaaaatcaaatactgtaacactattctttaacttgcatgtcaatctattttgttttaccaaaagattatttattctctcctaactttactacttcattggctggtttgcaaatctaagatattttctctcaaacaggtacttgtaaagttacaactcaagtgaattcttccctacaagggagagggagaggaacaagaaagaacaaaattcattttgaatactaatacccaattttccagtctcttctgaagttaataaaatagctaattaatgttgcaaaaataccaccaagatactggtgcccacctagtgaataaagcataatcgtgcttcctttccctaatatcccaaaacagagaagagaaaaaatgactcctatgcaggagcctcacctggagtgactttgttccttttatcctctttgaacccctgcaaagtattcactccagactgaagtcttccagttgtcattcccagtctcacagggcagtagcctggctctacaacataaaacagagcacagtgaaggaggcctacatggccatgacccacggggccctctgccgagtgactccgcacaaaccactgcatgtcatctgcatgaccgtgaaggaggctgggaagcgcttactacatccacttttataagaaaatcaaagctcagaaaggcagaactatagccaggaccaaaactcagacctgttcattacactctcctgcttcctggaattctttataatcatgtacacttcacttaaaaaattaatttttattaaaaacaaaagccacaaaaacttttaaaagctgggacttttaatgttaagatgaaagttaaccagtacaaaggttagtaaaagactgagggaaaacacctgcattaaagacaaaagggctactaacacatgaaggataaatgagtatctatgaaaggcatacttttagtgcaacgagaacaggcattagccaggaatgaatccctgtgatgaagctgggaatacgtgacatagagaaatgtcacgtatgggcacctgaggggactgcaaaagatgctggcaggagaagatgtggtctcccacagtatctaacagagggacatctgctctcctgaagaagagtctgagtttgtgtcacatgatcagccttcaacggaggctactgccatcagtgaccagtgtggtgaaggcactgttaagcaactgaacatctaaatcagatcttctctcctcagccaacagtctggaatttggtttcctaataggtacgggtaccagacaatgaagctgagaagatgaacaggggtgtcttctaccttaaaccatgaaagtggcctacagagggagctgtgcacacggggagccaagtcagctttggccacatttgattaggtctcagaaactggaaacccaggaaaccagagcaaggacagagaccacactcggcttcacagaaagcagcagatcttaaggtgtcacctacatcagttagctgcatctcctaacaccaaatgttcaccacagctatagtagaaagagcaatgttctcaatcctgtggcattctttgacctatgatcatataaaattctacttgtctgcatcaaagtagaaactgagttttgttttgaaaacagcactagctccttttcttctattactgttctcctcctttagagaacattcatagtccccttctttccatcttcaaatgctcttccctgcttcaaggttttcacaactgctgttctctcatcccttactcaacctaaacatcatctccttaaggatgccttccctgacccccaaacactaggttggtatcttctattatgatcatagctgttcttttcctttgtagtatttattcattatagacacacacctgcatagtactgattaaggacagacttctctttatgtgagtcctcttcccccgactccatagaacaaggaaaagggactcctctctctctgttttgttctctactacacagctagctcctaagacagcaccctgctcacagcaaacaataaacatcagagactgtttccttaagggtaaaaattctgtcattattcattttcgtatttccaattacttctttcattatgacagtatgaaaataaatttgttgaataaattaacattctcacatttgcatatctcaatacatgattctctcctcagaccagtgacaaaaagttctaattgtgacatcgaatttcaaaatataacctatatgatttccattaaaacatcatttgagaaaacaaaaatatgactgaggttctaaagattcccaatctttacaaactttctactgactatagtgaaagatacgatgtcactaagcatacaccttccattattattaaggcactatgtggcatatacattcattttattccctgaaataaacagttaaatttataatatcatattctgtgtgtatgagatacctctaaactgagtgtctatactaaagtctcttaaaaccagggctaggaattactatctaaaagttatggctttgttaatggcgggtttaaaatatttcagggactttgaattttaaggaaaacttgatatactgtacctatttcaagatgaagtgaaagttaggctagctgttaccatgaaatacatgatgtctagctagatcctttgtgcataatgacacagactgatcaatattcaagcttgttgctttaaaatgttaacccaggttactgttctctgccaaatagcatcaagttcatgcacagttttactctgatcctacctcctacaatgggatccacaggatggagaagtcccaacgtcgttgttccatctggttttcttctttcaaattcgcactgcaatgacccaaagtattcagatggaatgaagtgttttatacaaacaggctgagtatcctttatccgaaatgcttgataccagagtgttgtggattgcagattttcccagattttggaatatttacatatacataatgagatatcttagggatggaacataaaattcatttatgtttcatatacactttacagatacagccagaaaataattttatacaataaataattttgtgcacccgtcacatgaggtcaggtgtggaagtttccacttatgtcatcatgtcggagctcaaaaaatttcagattttggagaatttcagatttcgaatttctggattagggatgctcagcctgtaccatattcatatatgcagcaaaccacaaaggcttattttaaccaaactaatattacaggtggctaatcattaaactcaagatactgactttcacacaggggatgatgggctagagaaatggaggtgaagaaaatctcagaattctaagagctctgtgggtccttaaggccacctagtcctccccagtctatcaaaaaaggctactatggaccaggtgagggcagtggcttgcttaaaggcatgtatacacctacttggctttaaaaccaacgtgacagggacccaccatctcactgccacccaagacatggcttctgttcctaagtccctgttaaatgtttctttctggaaacatttaagctggaacatgtggtgagctagtcaggagtggagggaccaagaaatgggcaaagggaaggaagcatccgtggaggaaatcccaggtggcagccacttcctcgttgagtggtatggctcatgttttagatgcctgtgcgtgagtacaaggacgccctgaaaacactagtgtatttggagtgattgtcggctgagagccatccatcgcactgtggtcaggaagggcagccggcagccactgcagcaagatggccacttttgtgggctgcttgtttggcaacaggagcccagctagcagcagaagcaaaagtaaaacaacctgagtaggaattacaattaggaaaaatattttttaaaaaagagctctatattcaaatgtcggctcagttaaaactgctatttgggctatacatatacacacatatgtctactgttttaacgccgctgtaatggctctgtaaaatgtctcagtcaactgagttctgtttggctgtccccccttcctcttgccaccctcgataccatattagggacctaaaggaatttctggcagcttgtgatctcttgagtaaacagaaaaggcatcaaagactcctctttttgggaagaatctctgtttttcctcacagaataccaagagttgtaagcagacagattcctctcagatctaaaactctgctcttttctgtattgtattacctgatctcttcagctttctggggacccaggattcagtgatttggggtgatctaaaacctgccttccagtaagtattaggccctaaaaactgcatgctttcttggccctgttccttaaagggctccctcttgaaaccagtaatctaataaggaaacaagttaagttgaaaagaggacactttttttttttttttttttttgagacagagtctcgctctgttgcccaggctagagtgcagaggtgcaatcttggctcactgcaacctccttctggcaatcaacttgttttcaggtaatggtgtttaggtatagcttctgtgcctctgagatgtaaattttctaccttgtttcgtctactttgttatgactttggaaatgactgatagtctaagagggggagagaaagtgaaaactggcaaatgaagaatcttataaatctacaagatctgcttctgtgtgtttgtatgtctatatatgtgtcatgtgtatgtgatgtatcactaccaaaatatacgaaagagctctaatcaactgaccaaagaaaagtaagtgcttaaatcaattattttatttaaaaaaaacagaatttcgctcaaatgccctttagttcacacaactttagtaatccttggtaaataaaactagtttcaaaattctcttcagtaattttaaatcttaaagtcatgttatattaagtaatcttagggttttcacttgaaattagggttactaaaagttaaaatagttaatatgttattaaaattactagatataagagaaacaattctatatacatagtatataaagaaaaatgtatttttggtaaagatacaatatcaatttacaaaaatcagtagcatttctataaaccaataatgttcaagctgagcaccaattcaagaatgcaatcctattcacaacagccacagaaaaaataaaatacctaagaatatatgtaaagaggtgaaagatctctagaagaactaaaaaacactgctgaaagaaatcatatatgacacaaatggaaaaacatcccatgctcatggaataatcaatattgttaaaacgtccatactgtctaaagcaatctacagattcaatgctattcctatcaaattcccaacatcattcttcacagattcagaaaaaactattctaaaattcacatggaaccaaaaaggagcctgaagtgccaaagcaattctaagcaaaaagaacaaagtcagaggcatcacattacccaatttcaaactatactacaggctgggcacggtggctcatgtctgtaatcctagcactttgggaggctgagttgggtggattgcttgagttcaggagtttgagacctgcctgggcaatatggtgaaacctcatttctacaaaaaatacaaaaattagccggacatggtgtcacgcacctgtactttcagccacttggaaggctgaggcaggagaattgcttgagctcccaaggtggaggctgtagtgagccaagattgtgccactgcacactccagcctgggcgacagagtgacaccctgtctcaaaatcaaaccaaaccaaacaaaagctcccataaaactacaaggctacaataaccaaaacagcatgatactgataaaaataaacaaaataactcacagaccaatggaacagaatagagaacccagaaataaagccacatacatacaaccgactgatctttgacaaagtcgacaaaaataaacaaagtagaaagaccactcaataaatggcgctaagaaaactggctaaccatgtgcagaagaatgaaactgaactcctatctctcacaatatacaaacattaactccaaatggattaaacacttaaatgtacgacctcaaattataaaaatcctagaataaaaccttggaaatactcttctggacatgggcctcggcaaagaattttctatgttctcaaaagcaaaagtgacaaaaacaaaaattcacaagtgggacctaattaaactacagagcttctgaacagccaaagaaactatcaacagagtaaagaaacatcccgcagaacgggagaaaatatgtgtgaactacgcatccaataaaggactaactacgcatccaataaaggactaatacccagtatctataaggaacttaaatcaacaagaaacaaacaaatagccccattaaaaactaggcaaaggacatgaacagacaccactcaaaagaagacatacaagcagccaacaaacatatgagaaaatgctcagcatcactaatcattggagaaatgcaaatcaaaaccacaataagataccatattatatcattactaaaaactcaaaaaataagagatgctggcaaggttgtggagaaaagggaatgctcactgttggtgagaatgtaaattagttcagctcctgtggaaagcagtttggagatttcccaaagaactaaaaatagaattacaatttgacccagcaatcctaggtatgtaccaaaggaaaataaatcattttactcaaaagacacatgcatttgtatgtttactgcagcactgtgcacaacaaagacacagaatcaacctaggtgcccaccaacaaaggactaggtaaagaaaatgcggtacacacacacaccatggaatactacacagccataaaaaagaatcaaatcatgtcccctgcaacgacatggatgaagacggaggccactatcctaaacaaattaatgcagaaacagaaaaacaaatattgccatgttctcacttaaaagtaggagctaaatactggtgcacacagacacaaagatgggaagaacagacactggaaatgctaaaagggggcagggagggaagggggcaagggttcagaaacttcctactgggtactatgttcactatttgggtgatgggttcaagagaagctcaaatctcagcatcatgcaatatacccacgtaacaaaatggtgtatgtaccccttgaatctaaaattaaataaaaccaacatgctaaacaatatgatttcaaaagaccagaatacaaatgttttcctgtaaatttaaattctgtagttcatgttccaattttagaacatattataacttcattttttaaaaatccagtaaaagagggtaagattaatcatgtactttacaaatgaacacagatggtcctcaacttacaatggagttacatccaacacgcccactgtaagttgaaaatatcatgagttgaaaatgcatttaacaccctgataaacccattgtagggaattgtctgtccattattaattgtttttctgctaagtattatactgatgaagagctctatggcagatatggattaaaaatacgcaagcaatttaaaaactaaaagtttcagatgccccaaatcagtaggtagagaaaagaaaaggcaaagctcaatcacctgactgttcacaagccgcctggtcagctttcctccagattccttcacgatgcggtcaagctgctcctgctctctctctaaattattgcttttaaacttatcttcaagcatatctttgtctttcctgaaaatatacattaatactaagtaaaaaaaaaacaaagataagtaagatgaaaacattcaaatgaattctaaatatgaatacaactaaagtggagacatttgtactacagtcactcattgaaacttacttccttgatgacctgttaagggtctctaatttaagaacagaaacagtaaggcacacctaacatgttatttccctacctttttctgtccagtgttacttgtgttaaacgtttttctgggaacttacaaaaaaattagttctacctcaaacattactttgaagggagaacaatataccattgttcttttaaagtttgatttttaaaatttaaaacaagcacttaagtgtgtaaatcttagaacaaagaaaaacttgtcactagtttactttctttgcattatgacagcaaaaatcccaaactgctaactacaaccctccccaaagttggcagtgaggtgctgggcggtcagggctggctcccagtagtgtgaacgggcagatgcggctgccgtcagctgcacaggtggctgcctaggtggaacagtggttcagcgttgctcccaccagctgacattgggtggaaaacatgggcacgctgcagtgacagcccatctgcttaagacgcagcagtgcctgtgctcccactgaactccttgctcctttatggaaggaggtaatgactatgcattttttcttaaacaaacagttctatttaaataaactcactgaccatatcagtcccaaaagacactttataggttttaaaactacttcaataagaatacacattagaactgctttctgaactgtgtttggacaatcccatatagtgcttcatatgagaagaggggtatcacaccatcaaaatggactttcatgccaaaacaccaccaccaccgacacactagcacttggtcttcccaagtcaggccccgaataagtatttttcccccttactagcttgaagaagacagtttgaccttaacatcccaaagatcttttactttttattttctttgctgggactcttgaaggcgtgtgcttcggcatctccagagtcctctctctctctctgccagcagcctccgtcctccccactctgtgaggtgtctgttccatctttctgctttcgagttttctgcaagtcagccatgaagtctatgctctgcttcaggctctgaattctttcctaaacatattcgaaaatattcttattatatgtttgtcattaacttttaaagtaatgcatttttttccccacaggagtttatacttatcctgtcattaaccagggaagaaaaacaattaaatgtaatcatataccaagagagtattgtatttggaaaccatgataatgcctacaccttcaattcttaaaatttaatttccaacttcatagaaagctttacaactttattgccctatcagaaatttaacagaggagaaagtatgaattaagactaagtattctttgaagtactgaattggaagactaaaatttagtttaatggtgtgttaacattttgtgtttaacagacaggcttatcttttgacagttaagaactgttaggtgtatcaaagcctagggcatgtgagcgtgtgaagtccctctctgttctggtagcccagtgtgctcacggatgacgctggcatttcactctgtgtgaaaacaacaagccttgaggagaagacagttggtggcacagttccttcctcagagtgcagaatggtttcgctaaccaaagaagtcttgtttctattctgtgaaacatgtgcttaatttttcgctgcaatgatgtgctgtgaaattttcattgtagttaagggcttgaggtttctccgtaaattttaagaaggcatatttgtttctactgactaccttgcctgtactctgaaagttatcactgggtaaaatagagtgcaacctccttagggctgcacagcaacagcagggaagacttctgtggagtaacataaactaagaactagaaagaaccagaggccattcaaacaagaacaacgcagcccaggaacaacaaatgactcacctaaggtcactaaaccagcaactaagactaggcttgctgtcactcatgttgggcctttcctcatcacaccatgctctattagtagtgcagatggtgacatcctcaccaacacagttcttgctgttttttactggacttttaaagtaatcttaaaaccattaaagcgatctattttattgtggacaaataaaaatatgggtagaggagaaaataaaaatcctcctaatgtctcatccagagaagaacagtgttaacaagtttattattccagtacttttccaaccattacataacccagcaaattggaattatactgaatatttagtaaaaagcattttttcagttaataaattataagcatttcctctccatatcaatagatatttaaaatattttaataactatttaatcccacgtctacaccatgatttaattaatggcctatgattgaacatttagatttccatgtttccactattataaataaaagtaccatcaacatcattataaataaatctctctaggaaccagtatctctttaggataaactcttagaaaggaaacaaagtcaaagggaatgaatatttttgagacttttgataattactgctttccagaaaaggtataccaatttacatactaatttacattagtgtttgaaagtttctctgaatccttgacaaaatcaatagtatcacttaaaaagctaacccattagaatcgcttgaacccgggaggcagaggttgcagtgagccgagattgcgccactgcactccagcctgggtgacagagtgagactccgtctcaaaaaaacaaaacaaaaaacaaaaaacacaaacaacaacaaaaagcaatcttatttgatttttaaaaacacgttttattttgctacattaaaaatattagtgagtttaattatttctgtaagttctcagtaataattttatttccactctagaattttataaagcagaacttacattaagaatgctttggggttttaaaaaacacgacatgcacaaaataaattcaattagagaaagtttctaaaccttgaaacaagtcccaggaaagagtgaagtttaattttcctttgaaagcaatgtctttttctttttttggtaattaaaatgcctccaagtcagcacattattgatcttcaattttacaatattaaatggctaacagggctggttctttgctaataatatagctaacatttacttagtgcttacccatgtgccagacacaactccatgaggtaagtactactattatccccactttacaggacaggaaaaaggctgacaaaggttacctgggctaaagtcacacagcttccaaagggtagagctaggacttgaaccttgattggtctgatttcaaagccactatgctacaaatagtattgtttgtactactttgtttgtactacaatgcagcattttactcaagtatttatttaggagataaaaagttactcttcatctgttcattcttctttttttttttttttttttttgagacggagtttccctcttgttgcccaggctggagtgcagtggcgtgatcttggctcaccacaacctccacctcccaggttcaagcgattctcctgcctcagcctcctgagtagctggaattacaggcatgcaccaccacgcccaactaattttgtatttttagtagagacggagtttttccatgttggtcatgctggtctcaaactcctgacctcagatgatccgcccacctcagcctcccaaagtgttgggattacaggcatgagccactgttcctggcctcatctgttcattctttataaaaataacacgtctactaatagttgttatttgagtgtaactgaaaaaatgatgagtgactactctacaattttttcaatgaacattcaaaaacagttatctttgaaaagacaccattcacggaagggtgtgctgggctctcttggagcacaaactattagaagagttaactcaaaaggtctaaatttaaacgtttaaaaatcactgttgtgacgacccctcccctgtagggtggagagaacagtcaataggaagctaataacacaggatgggtggggctcctcaacagcaaaagatctgaaaaaaaggaagacaacagagagaaagaaagagggagagagggaagggaaagtgaagaaaattttattttctgtgctttcaaccattccacacgccagtaaaattcaagagataatggaatcttttgcttgttgtattaactacattacttaaggaagtggtaaatcaaaggtcattaaaaattaggctcccaccacccaattcaatgtacatattttggagtgactaaaggctgcatttgacaaatgcatttttacttcaaatacattaacaagaagcatttccatgtctttaaacctggaatatggcatggttctagattctgagagtcttcctgcaaagaatgggtaaacatttcatattcctctttcctctgcgaatgttgtcaaagatgggtaactggcttccattagtttcccaagtctttaggaaagggtgggaaccaaagttgtctaaatattaggagcgcaagaataatcaacaatccaaacatgtttttctttctctagttaagtgaatccaagaatctctcagccaagcatacagacactcagacatctgcacaccaaggcatttctttaaatgtaaaactgtaatacagaaaaatgaatcaccataaaaatcgaaaaaccacatgcagatgcacgactcatttttatcatcctttaactcccctgaatgtgagctcaagctctggactctgattcctttctccttctaccagtgtcttatacccactcatttcttctttgcaaaatccctgtcctatcttgtggttctttttcatagtatcctctctactctacctcttatctagaatcagaacagtaatgctagaaatcatcttggagaccacagactaaacccttctttagggatgagaacactgagtcccagggtagttaatgtcttgcccaaagtccacaagttagtggaagagagctaaaatgaaaactctcttctgcctgcctgccatggtatggtatggtgccaggatcacccttgattcgttccctaaagtagtctcttacataggtttctcccactcagagtggtgagaaaaacctcaaaagatatggcttatcttgcgagttattttctccagcggatgcacagtgatcatctcagcttacccttcaaagccttttatcaactgtcgtcctggggacactagtaattttttgccactgtgtataatatctcatgtttacgctctttcctgcagtttgatgatgatgtgtctgtgcctacgcacacacttctctgacctcaaatgacttactatgcactaattcttaccctttaaggaagagtctgctgttgtggagaggtggttttgagacagtttcaaattttctctcatttgtatatagtcacatgtagcttaatgaagggacgcgttctgagaaatgtactgttaggcaattttgttgtgtgaccatcaatgagtacactcacacaaacctagatggtatagcctatcagacacctggctaaatgatatagcctactgctcctaggctaggaacctatacagcatgttaccatactgaatactgcagacagctgtaacacaatgctaagtatgtgtgcatttaaatataacaaaagtacagtaaaaatacagtattacaatcttatggaaccaccactgtatatgcagtctgtatatacagtattatgcagcgcatgactgtattttcttactagaaattctgtgcttctgacaggactgaccaacgttagattccacccctacaaatgcaaacagagagctttcctcttcagagttctcacaattcagccagtcttatcctggaattcaggctgatgtttcaagctgatgttttatgtcttaagagataattacaagtgaatgccaatatttatttgtattgattccaagtaagaattttcctgtcttaattttcttctctttattaaaatttttttcatttagtattttctactttatttaatataatataacctgctaataaaataaaatcaatactgtattgtatctgtattactatggccaacaaacagcgacacagattttaataactattatttatgacaaagagtttcctttacctggctaagaattttcattcctgagtgcaacagcttctttgcagctttataataaatggtctctggtttattgtaaatcatggcattagtacacattagtttgaagttatcctgcagaaagaacattaagggagaaaatgcattaatgcaaaacaaactaccctgcacccccaggttgaaaatatacaggtcctctaaaaatttaaaaagcaacatccctttctttatttactaaacaatactaacagtaatttattaagttttaagactcaccaacaaaacaaatactgctaaatgtatttaaatatgctatattatttcccaaattcttaaatattttatagtacctgtatataaactgtagatcccagaatgaaacttttaaatgggtttcttcagtataatcttactgcacataaaaaaaatgtgaagaaaatacttctatttcatatgtaatgattttagctgagtagttcatgtaaataaaaaaaatattactcctagctttaaaacaaacatcttaaatttccatttaggaattgaacattttatttcagatcttgactgaaaacggagcagtcctaaattatcgcagtatttcctgccaaattcacattaactgagcaaaaaatgttaaaacatttacactacttttatgtgtttggatactatcataaactaaacataatttgcagaatgttgcaaaaccatgccaatgtgaaataaaccatacaacctcaaggagttaaaacatgtaactggagtagccaaattaccaaaactgtctttttggcttaaatttccaagtccgctatgtgctggagaacttgaccccactgcatgctttcatagttaagtaatttttacatctataaatgtgcgattcattatgccaaggccttactaagttgaaagaaaaacccaagaaaagagaatctgccccctacaaatttgtttaaaaaacaaaaaaaattcaaattccactatttaatagtgatgacaggttagaacacttaaatagaacaaaaataagtagactgagttctatgtacaagtacgtaagactgagtgaagggtcgcaataaatttggtattaaagtggatgaagtatatgtggatcttcagtttgggccatgactgtaaatatgccaggtcttggatctctaagcatctgatgaaagctatgggaccagaccttaagtacacacacacacacacacacacacacacacacacacacacacagctgaacacaaaagtcttcatgtaattttagtaggttcttggtccctctaaaggctcattatggtatccaaaggaccctagattaaagacctttgttacagatatttggaaaagcttccaggccattaagaattactaggctgggcatagtggctcacccttataattctagcactttgggaggccgaggcaggtggactgcttgagcccaggagtttgagactggtcagggcaacatggtgaaaccccgtctctactaaaaatacaaaaaaattagctgggtgtggtgacacacccctgtagtcccagctacttgggaggctgaggcacaacaattgcttgaaccctgaacgtggaggttgcagtgagccaagatcatgccactgcactccagcctgagcaacagagtgagactcggtctcaaaaaaaaaaaaaaaaaattaaatatgtatttggggggatgggacgcaagtgaacggagatactagattactatatatactcaaactaagtgaccatttggcctataattggccagataatgggcctatgaactggcaagagtactgaattgttctaatgaacacaggactgatctattaagccaatttgtagattccttaaatcttaacataatgtgctgggctttactgaactgtgggtgatggcactggtcattcaaaaagctgagtcttcctgcacacttttcacacacacacacacacacacacacacacacacacacacattttacttcaactgccaaatgaactgaataaatattactttaggccgttgagctttccctagaaaaaagtggcaacgtagaaattctaaagagctaagataccaattcctttcaattatgataaaccctaacctgcttaaaaacactctggggacacacttctactcttcttactgtaagagaaagatcagaggaaaatcatgcagaaaaaaaacaaaaaacaaaaaactgtgaaattctttcccattaagcaatggtaaggtcagaaatatgctgaaataaacggttttagcctaattttcaccagataaaaagttgggaaaagtttctatttctcgaaataagagagaatgtaattcagattctttggagaaagtggaatattacctataaactcaacagtaaagagcactaaacactgatattcttcataaatctctgcttatcaatatgtggatgaaaaaagggactaagtaaagacactgtctttttttttttttttttttttgagatggagtctcactctgtcgcaagctctgcctcctgggttcacgccattctccggcctcagcctcccgagtagctgggactacaggcatccgccaccacactcagccaatttttttgtattttcagtagagacggggtttcactgtgttacccaggatggtcttgatctcctgaccttgtgatccacctgcctcggcctccggaagtgctgggattacaggtgtaagccaccacacctggccataaagacactatcttattttatttttaggaaaataactaattagggtaaccaattagggtctaacccttataggtcaggtgagcactactgtggttatgtaaaacaaagtagaggtaaaacagatattatctaaaccaattaagtttgtggcggttgaatacatagtaaattttaatatacatggttcctttccctggaatcaacacacaccaggacactccctcaaatgggaaaaacctcatctataataggtatatatattataagttttcaggtccttgtaaattttctatactcttcttaaagctgaagaaaatatgctcaacaaatatagccaaaatgaactcagagagcaattaactttcatcaaattagaaaatgtaattaaacttctctttagtatttctggacaagccaatttattctttactttagagtacatgtgatatggtttggctctctgtccccaccccaatctcatgttgaattgtaatccccaatgttgggggaaggacctggtgggaggtgatttgatcatggaggcagatatcccccttgctgttcttgtgataatgagtcctcacaagatctggttgtttgaaagtgtgtagtgataggttccaaggtggccgaataggaacagatccagtctacagctcccagcatgagtgatgcagaagactggtgatttctgcatttccaactgaggtactgggttcatctcactggggcttgtcggacagtgggtgcagcccacagagtgtgagccgaagcagggcagggaatcacctcactcaggaagcacaaggggttggggaattccctttcctagccaagggaagctgtgacagactgtacctggaaaatcaggacactcccaccctaatactgtgcttttccaatggtctttgcaaatggcacaccagattatatcccgcgcatggctcagagggtcccatgcccacggagcctcactcactgttagcacagcagtctgagattgaactgcaaggcagcagtgaggctgggggaggggcgcccaccactgctgaggcttgagtaggtaaacaaagccaccgggaagctcgaactgggtggagcctacctctgggggcagggcatagctgaacaaaaggcagcagaaacttctgcagacttaaacgtccctgtctgacagctttgaagagagtagtggttctgccagcatggagtttgagatctgagaacggacagactacctcctgaagtgagtccctgacccccgagtagcctaactgggaggcacctccctgtaggggccaactgacacctcatacagctgggtgcccctctgagatgaagcttccagaggaaggatcgggcagcaacatgtaccattctgcaatatttgctgttctgcagcctctgctggtgatacccaaacagggtctggagtagacccccagcaaactccaacagacctgcagctgagggtcctgactgttagaagaaaaactaacaaatagaaaggacatccgcaccaaaactccatctgtatgtcaccatcatcaaagaccaaaggtacataaaaccacaaagacggggagaaaccagagcggaaaagctgaaaattctacaaatcagagcacctcttctcctccaaaggaacgcagctccttgccagcaacggaacaaagctggagggagaaagactttgatgagttgagagaagaatgcttcagacgatcagtaataacaaacttctctgagctcaaggaagatgtttgaacccattgcaaagaagctaaaaaccttgaaaaaagattagacgaatggctaactacattaaatagggtagagaagaccttaactgacctgatggagctgaaaatcatggcacgaggactacgtgatgcatgcacaagtttcagtagccgatttgatcaagtggaagaaagggtatcaatgattgaagatcaaatgaatgaaatgaagcaaaaagagaagtttagaggaaaaggagtgaaaagaaatgaacaaagcctccaagaaatattggactatgtgaaaaggccaaatctacatctgattggtgtacctgaaagtgatggggagaatggaaccaagttggaaaacactcttcaggatattatccaggagaacttccccaacctagcaaggcaggccaatattcaaattcaggaaatacagagaatgccacaaagatactcctcgagaagagcaactccaagacacataattgtcagattcaccaaagttgaaatgaaggaaaaaatgttaagggcagccagagagaaaggtcaggttacccaccaaagggaagcccatcagactaacagcagatctctcagcagaaaccctataagccagaagagagtgggagccaatattcaacattcttaaagaaaagaattttcaacccagaatttcatatccagccaaactaagcttcataagtgaaggagaaataaaatcttttacagacaaacaaatgctgacagattttgtcatcaccaggcctgtcttacaagagcttctgaaggaagcactaaacgtggaaaggaataaccagtaccagccactgcaaaaacaggccaaattgtaaagaccatcaaggctagaaagaaactgcatcaactaacgagcaaaataaccagctaacatcataatgacaggatcaaattcacacataacaatattaaccttaaatgtaaatgggctaaatgctccaattaaaagacacagactagcaaattggataaagagtcaagacccatcagtgtgctgtattcaggaaacccatctcatgtgcagagacacacataggctcaaaataaagggatggaggaagatctaccaagcaaatggaaaacagaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagttacctaaaaagagacttagactcacacgcaataataatgcaaaactttaacaccccactgtcaacattagacagatcgacgagacagaaagttaacaaggatatccaggaattgaactcagctctgcaccaagcagacctaatagacatctacagaactctccaccctaaatcaacagaatatacattcttctcagcaccacactgcacttattccaaaattgaccacacagttggaagtaaagcactcctcagtaaatgtaaaagaacagaaattataacaaactgtctctcagaccacagtgcaatcaaactagaactcaggattaagaaactcactcaaaaccgctcaactacatggaaactgaacaacctgctcctgaatgactaccaggtacataacgaaatgaaggcagaaataaagatgttctttgaaaccaatgagaacaaacacacaacataccagaatctctgggacacatttaaagcagtgtgtagagggaaatttatagcactaaatgcccacaagagaaggcaggaaagatctaaaattgataccctaacatcacaattaaaaaaattagagaagcaagagcaaacacattcaaaacctagcagaaggcaagaaataactaagatcagagcagaactgaaggagatagagatacaaaaaacccttcaaaaaaatcaatgaatccaggaactggttttttgaaaagatcaacaaaattgatagaccactagcaagactaagaagaaaacagagaagaatcaaatagatgcaataaaaaatgataaaggggatatcgccactgatcccacagaaatagaaactaccatcagagaatactataaacacctccatgcaaataaactagaaaatctagaagaaatggataaattcctggatacatacaccctcccaagactaaaccaggaagaagctgaatccctgaatagaccaataagaggctctgaaattgaggcaatagcctaccaaccaaaaaaagtccaagactagatggattcacagccaaattctaccagaggtacaaagaggagctggtactattccttctgaaactattccaatcaatagaaaaagagggaatcctccctaactcattttatgaggccagcatcatcctgataccaaagcctggtagagacacaacaaaaaaagagaattttagaccaatatccctgatgaacatcgatgcaaaaatcctcaataaaatactggcaaaccaaatccagcagcacatcaaaaagcttatccaccacgatcaagttggcttcatccctgggaggcaaggctggttcaatatatgcaaatcaataaacgtaatccagcatataaacagaaccaaagacaaaaaccacatgattatctcaatagatgcagaaaaggcctttgacaaaattcaacagcccttcatgctaaaacctctcaataaactaggtattgataggacatatctcaaaataataagagctatttatgacaaaaccacagccaatatcataccgaaaggcaaaaactggaagcattccctttgaaaactggcacaagacagggatgacctctctcaccactcctatttaacatagtgttggaagttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtacaaaaatcacaagcattcctatacaccaataacagacaaacagagagccaaatcatgagtgaaatcccattcacaattgcttcaaagagaataaaatagctaggaatccaactcacaagggatgtgaaggacctcttcaaggagaactataaaccactgctcaatgaaataaaagaggatacaaacaaatggaagaacattccatgctcatgggtaggaagaatcaatatcgtgaaaatggccatagtgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagacagagaacaatggaacagaacagagcactcagaaataataacacacatctacaaccatctgatctttgacaaacctgacaaaaacaagaaagggagaaagaattccctatttaataaatggtgctgggaaaactggctagccatatgtagaaagctgaaactggatcccttccttacaccttatacaaaaattaattcaagatggattagagacttaaatgttagacctaaaaccataaaaaccctagaagaaaacctaggctataccattcaggacataggcatgggcaaggacttcatgactaaaacaccaaaagcaatggcaacaaaagccaaaattgacaaatgggatctcattaaactaaagagcttctgcacagcaaaagaaactaccatcagagtgaacaggcaacctacagaatgggagaaaattttcacagtctatccatctgacaaagggctaatatccagaatctacaaagaacttaaacaaatctacaagaaaaaatcaaacaaccccatcaaaaagtgggcaaaggatatgaacagacacttctcaaaagaagacattcatgcagaagacacgtgaaaaatgctcatcatcactggcagtcggagaaatgcaaatcaaaaccacaatgagataccatctcacaccagttagaacggtgatcattaaaaagtcaggaaacaacaggtgctggaaaggatgtggagaaacaggaacacttttacactgttggtgggactgtaaactagttcaaccatgtggaagacagtgtggcgattcctcaaggatctagaactagaaatagcatttgacccagcaatcccattactgggtatatacccaaaggattataaatcatgctgctataaagacacatgcgcacgtatgtttattgtggcactattcacaatagcaaagacttggaaccaacccaaatgtccaacgatgatagactggattaagaaaatgtggcacatatacaccatggaatactatgcagccataaaaaggatgagttcatgtcctttgtagggacatggatgaagctgtttctgagcaaactatggcaaggacagaaaaccaaacaccgcacgttctccctcataggtgggaattgaacaatgagaacacctggacacagggtggggaacatcacacaccggggcctgttgtggggtgggggcatgggggaggggtagcattaggagatatacctaatgtaaatgatgagttaatgggttcagcgcaccaacatggcacatgaatatatatgtaaccaacctgcacgttgtgcacatgtaccctagaacttaaattaaaaaaaaaaaaattaaaaaaatgtaaaccatctaaaaaaaaaaaagaaagtgtgtagcacttcccccttcactctctcctgctgccatgtgaagacgtgcttgcttccccttcatgttccagtacgattgtaagtttccttgggtctctccagccatgtgtcctgtacagcctgtggaactgtgagttaatcaaagctcttttcttcataaattacccagtctcaggcagttctgtatagcggtgtaagaatggattaatacaatatgcatatctcatatgtctagaaatagaaaaaaccctcaactttcattaaaatattcgttttacttgtattgatctaagctaaaaatttcactctaaggttggaaaaaatatactgtggaacacatatcaaactcaaaatttcgctaaagacaaaaataattatgaatgaaagatatcagaggacctatttcatctggttttccatcaccaagctcataaagttttctgaagcagaaataaacaaagatactggatcttaaaataaactcaattctttgcaaaataaaaggtcaatgagaaagattctgaatatcagacatgcagatttctaccaagattttgtgtatataggattgaagagttacctttagttcttctatggactgatagtcattgttcttgatcttttctttcatggtactaaaatccattgggtgtttaatgatcatggagtagccaggagcaataaaatcagtcacaggaaatgaaaagaaagcacttggatcttttctgtaaagatatgcaaaagacaatgtaatattttattctattacaaacaaatctattggtctaggagcagaagtcagaggaaacccttcagatgcagaaagaatttgtaatatgttaacatatttttaactgaaaactgaagaaatgattttaaagtctattaagtatttcataacaaggaagttttacatactagctgtaccctcaggatggagatttctttcttttaaaatacacagcctcattaacagctacacttatacaggaaaacatgaagcaaaataaacaacctcaactaactgaccaatgttttaacctttgggagattagcactgcatatttttaaccaaccaaaggggaaaaggctaaaatagtaactatgaacatacatctacaatcctccatattaatttctaataggcttgcatttctggtccatgcatgtctattttctccataaatggatataacttctatcacgtgtatgtgggggatgctaaaaaaactgacattaaaaaggtcctcttaaatacctccgtatgtgtgccaagacaggactggaccaaaaaaaccccaaaatcagaaactcaaatttgaaaactagtgcttttcatcacagattcacaacactggctgtacactagaatcacacaggagctttaaaaaaattccaatgcggggaagaagcgggaggaagactcagcctagacccactgtaccagaagctcttggggaagaagggtagggtccaggcagtgatatttccacagatgagtattggcattgggatttgaatatttggcatttgtatttccagtattgtcaggttgagaatgagtgctttatatgattaaatcattatgctaattttttttccctctggaaatctggcacaccaaaagttttcttactccacagaataacagtaaaaatatggtttaaaaaataacaacttctttaaaaacatatttaccatgttgctagtcccagtggtaggcacttgacatattttatatcgaatcctcacaaaagccatcaaagtggtggtatcctccactaccggaggatactgaggctcagtgaggttgaaattatctatcctgagtcatgcattaaataaaagagtagaaatctgactcaggtctatgtgaatctgcctttgtttttcacagcaggatgcctaagcagtgagactaaaaaatgacaacaagcaaaaatacatagtcaggacccatacatcaaaatgtgcgctgtccacaggagttaccgtaacggcagcattcacccctgggtggcctcctgcagctaccctttggaggaaattatctaactcctaggtcagtcattttaatacagagccccatctagttttgaccaaaaatgctattatcaaacttgatcaactagattttttattttttaaaccaggcttagctcctggtaaggatgaagaatcatccaatcactaaaactaatcaaaacagtgtggctctgggttctaattcccaatgtctttagactaagaaatacttcctgaagtgttttttcattaagactttgtttctaattgacatataataattgcacatatttagagggtacagtgtgatgtttcgacacatatatactaacatacatatatacaaggatacttcggtgtatccttgtatgtatgtatgtatgtatgtataaggtgtaataatcaaatcaaggtaattagcatatttatcaccccaaacacttgttatttctttggaataagaacattcaaaatcctttcttttagctattctgatgtatataataaatggttgtggactgctgtcaccttactgtgcaacagaagaccagagcttattcctcccatctaactgtaattctgtacctgctgaccaacctctacctttcccttgcctctggtaaccactgttctactctctacttctatgaatcaactttttaagatcccacatgagtgagatgatgtcatatttgtgccctcaccatattttctgtcttcacatcagatgggtaatgtgctgatgttgtaacaaagtttgagggcggtatatctcacaaaggaacatgaaaacccaatcattacacttatgaactacaaaaggatcgtgcagtatttgttcttctgtgtttggcttatttaacatgatgtcctctaggttcatccatgttgttacaaatgatagtatttcattctttttaatggtggaataatactccattgtgtatacataccacattttaaaaaatgcattcatccattgatgggcacttagactgattccatcttggctactatgaatagcactgcaattaacacaagagtacaggtatctcctggacatactgatttcattacctttggatatatacccagtagctgaattgctggatcatatggtagttctatttttaattttttaaggaacttgttgtccataatggctatactaatttacatttccaccaacagtatatacaatttccctttctctaccacattcttgccagctttgttttttttttttttttgtcttttgataacaggcattctaattggggtgaggtgattttgacttgcatttctctgattattagtgatggtgagcattttttcatatacctgttggccatttgaatgtcttcttttaattaagtcatttcttttaaggtgacatcattaacctacattctggccttacgttgcaagaaaaactctaaggcagccatgacattttacagtcacaccttgtaaattgcaatggaatacccaatacctattcactcctttcggacaagtagtgaagtaatgaacaagttatttaaatataaagactagatgtaatttttctcaaacaccaaaaaagaagagagatcagtaagttcttttttttttttttttagaaaagatctcattctgttgcccaggctggagtgcaatggtgctatcacagctcactgtagcctcaacctcttgggctcaagtgatccttccacctcagtctctggagctgggactacaggtgtgtgcaaccacactaggataatttttatttttttgtagagatggggtctcactatgttgcccaggctggtcttaaactcctggcctcaactgatcctcccacctcagcctcccaaagtgttgggattacaggtgtgagctactatactcggttaacttctgatcttaactgcaaacctgaacaggcattgaatacagattacattagagaaaaattatttacaatgtgttctgggttgacttaagttcaatacaatgaaagaaagtccactgtaaaaatgtatgatctacaaccataaaccctttgcaaataatggaaatatctttgagctgaaaatttaaactctgagtagagagatatcaaaataaatatattttatttatttatttatttattttttgagacggaatcttgctctgttgcccaggctggagtgcagtggtgcaatctcggctcactgcaagctccatctcctgggttcacaccattctcctgcctcagcctcccaagtagctgggactacaggcgcccatcaccatgcctggcaatttttttttttttttttttaagtacagatggggtttcaccatgttagccaggatggtctcaatctcctgacctcgtgatctgcccgcctcggcctcccaaagtgctgggactacaggcgtgagccaccacacccggcccaaaataaatattttaataaagattgagttattcttttcccttttaagaactcaacagtagcttaatctaggcactgaaatttttagaaccaatttctgcatttaaaagaaggccataattcctatttatggtgttttattttttctcccatacttaataattgctaaacatttgtggcatgataagcattgtacaaatacatagaaggtatttccatctattagcaaagtggaaatatctgtattgtttattcctggcttaaagttttaacatcagaaattactttagagacagaaatttgtcattaaaagtattatgtaacacccttcaagttgccagggaaacaaaccaaataaagaatatctaaaagttagcctagcctcttggagtacttctgctgccaggcaaaatatttatcattcactttaaaatcacgtatgtttggagttaggcacaaatgtggtttggatcctacacatctaccattttaatttctatgttataaaaatattggaaaaacatttacctctgcaattgtctcatcagttgattcaaagcttcttgaaggggtgtctgttctacttctaaagcaaagaagaagggaaaagggtattttaaaaaggagtattctagagagtattatttactagatcattttctacaaccattattaaatatctcatacagaaattccatttatcttaaaaatatattgaagtttgagagtattaatccaaaattgaagctaatttaaagctcttatgcagtttgagagaaaaaacttaaaaattcaatcacaaagctccaacttagaagctaaaaccccaccattttcctgagctataatgatttcagcctcctcattcaggatagttaattcagagttattccaaccttcttgtttggctaaagagcttgtgagaggcttctcaggaggcaagtctaatctcacaggggcgtgacactggagatctttttctgcctcattctccacccggtctcgatctcgcttctttttatcctcctaaatggaacaaagggagataatttagaaatatttcagaaccaatatctttaaatacataaatcattttaaggggtaaaaagacatcattgtaaagaaaatattcttaataacaagctcaatgtactttactgccatctactggaaaaggagagaataatacgttcacgaaggaaaaaacaaagggggtctctatgccagaaataaccagttagaaaaacaatactatccaaaaaagcaacatagtgtatatagaaataaatctaataaaagatacccaaaaccttttgggaaaaactgtgaaacattactgaaggtcacagaaggcctgaataaaggagatatactatgttcatgaattcagagtcaatcctctctcaagttatcaatacattcgatgtaatgccaatcgaaatttaaaaacaaaaatttccatggaattcaacaagccaattgcattaatttacctcgaagagtgaacgattaagaacacaatagttttgaaaaaggtcagagtaagatgatacgtcttaccagatattatttgtataacgtgataataagacaatgtgggtctgacacacagacaaataagccaacagaagagatcagagcccagaaacagacccatgtacatagaataatcttagtatatcacagaggtgacattataagtcaatgacaaaagggtggtgctgagacaactgttacctgaaaagagaaaatagaatttgagctctacttcatgccatacacaaaagtgaattccagataaagacttaaatgtacaaagcaaagcttcagaacttcagataaaagaaaagcatctttaagacccaagagtagaaaaagactttcttaaaaagatataaaatgaataaattttaaaggaaaaccttgataaatttgatattaagttgataaattttggtacctcaacaaaatccatgaaccaagttaaaaatctaacgatagactgagataaagtacttgaaacacaacttataaaacattaaggattccatgaagagcatctataaatctatgcaaaaaggcaaaaaatccaaaaaagaaatagataagtgatatcacaggtaactcacagaataagaaatgtgaaatgttgagaacatgagaactagctcaagctccctagaacttgggtaattatagatttaaaaactagaaggcatttcgcctctctttggcaacatttgtctgaaatgtcaagttttgataaaaatgtagagaaatgggattttcataccttgcaattgggtgaataggaacaatccttagcagagcaattagcaatatctagcaaagctagcaaagcctttaacctacttctcaactgctactctctgtgcatataccagagaaatttcctgtcgtatggtctacatggagacttgtaagagattactgcagcattgtttaaaatagtaaaaaataggaataatccaatgcctattaaaaggaaaatagattaataaattgtgtcatatttacataacaggtaatgtaaatgagctaaaattgtattgtatcaacatggataacattcagaaacaatgtctgaagaaaagttgcagaacaattactgttacaagctatgtatgaaaatgtgtaagcatacattgtttacagatgtatgcagaacttgtaattataaaaacatgcatgtgatatacaccaaattcagtacagtggttctatcagaaggaaagacagaaatgggactctgaaagggtataagggatctctgtctgccctcttctttccttaggggaaaaaaaaaatatatatatatatatacacacacacacacacatatatatatggctaaatgttgagatctgttaaagctggatggttggtatcaagatggtagttttattattctctgtactctgcattcttaaaatttaaattctgaagtaaaattgtccaacaatgcccattttatgctcatcaaaatcaagattctcaacaggatcttatggactcaaaaagctattttcttggcctatgccctattttttatttctagtatctacagcaatggttctcaaagcatggtcaccagactggcagcatcaggattatttaggattttgcaagaaacaaaaattttattttgcaagaaacaaaaattcttgtggttcgcaagctttagtgtgcattagaatcacctgaaggtctcattaaaaacacagatggctgggccttgtccctagaattactgatctgcaggtatggggtagagacagagaatttgtactttctaacaagtttccaggccatgtgggtgttgctggtacagggaccacactttgagaatcactgatctagagctctgcactctattttcagaatccaaagcacctaatacagaatatatggttgttttaaaagttccagagagcagttataaactgaactcatgcttgatcccagctaccactgttagttggttaatgtatttttaccacctcacaacatattctgttgcagtaattcttaactttggaaaattttaaatccttcgtccagaaatactggtatggatcttggtaggctggcaagtttagaagatccattctatgaaataacagccacagagacacagattccttcctattaaatgtgacctgtgaagaaaggacagcttgagaggcagtatgcattctcccaggtagaaaaaactcatccagtgccagtgccaagagtctagaactggggccagcaaactttttggtcaacgaccaaactgggccaagtgcagtggctcgtgcctgtaatcccagagctttgggaggctgaggcaggtgtaccacttgaggccgggagtttgagaccagcctggccaacaaagcgaaactccatctctactaaaaatacaaaaatccgctgcgggtggtggtgcacgcctgtaatcccagctacttgggaggctgaggcaggagaatcgcttgaacccgtaggtagaggttgcagtgagccaagaacgcatcactgcactccagcctgggcgacagaacaagactctgtctcaaaaacaaaacaaatcaaaacaaaacaaaaacccaaaacggccaaactgtaaacatttaggctttgtggcccattaagttctgtcacaactactaaactctgcttttgtattatagtatgtgttgtagtatgaaaaccaccacagataaaatgtaaatgaattaatttggttgtgtttcaataaaaatttatttacaaaaactgttggccaacttgctaacctatgctctaagagtccagcttcatccttaaaacactctgctggctggatgcggtggctcacccctgtcatcccagaactttgggaggccgaggtgggtggatcacttgagctcaggagttcgaggccagcctaggcaacatagcgaaatccaggagttttggtgtgcacctggagtcccagctacttgggaggctgaggtaggagcatggcttgagcccaggaggtggaggttgcggtaagtcgagattgcaccactgcactctagcctgggcaacagagccagatcctgtctcaaaaaaaaaaaaaaaagaacaaaaagaataaagtaaaaaaccactctgtgaccttaggcaattcatttactctcatcagacctctttaccacatgcaagatggagatttaactgttattatttatcttacagagttgataagatggtcaatcataaactagccaagtggaaaaagtaccaaaggagggtatgtttctgaactacccctacctagtatctttacctagttatcctggtctaccgtaaccactttatcattcagtaaagcaaaaagtctttggggctagggagtccaaaagaaaaaaagaatataaaaacatatgcttggaaactaccctaaactgaatagagatatcatagcatgttatttccagactgagaatcaggagatctagcttctagttcaccagcatatgacttttaacaagttaccccactgttttagtctcagtttcccatctgtacaacacaaggctgtgatctctacaggtctctctccacctaaaattctgattccaacctttacattttctttttcataattcagagtatgttgcagaatcttgttgtgaatgtcacttattaaatgaatatagttacgtaaaaccataagttaacacagttctggttaacagtaaattctgttaattacacagaaaaaactaagcaaaaatattagtgccatttaactttaggtagttaaggaagaagagtttacagttagtttataaagcgggtttaaattctggcctcgtcactagtaggtgacaaagctatgatatggataaactatgtaattagctatggtgtcatggataaactatataattttttggagtctaacgttctaatctttaaaatagacacaagaatacatacctcacaggactattttaaggattaaatgtgatagtttatgtaaagttttagcacattacttagcacatgatggacactcattcattcaataaataaaagaggctttactgtgtggctatatagtgaaagagaaaatatacacagccctactcttacggagctcagagtgaaacagcagagatgttcattaaataactcattcaaaaaacaaacaggtttataacagcagagatgtgcattaaataactcattaaaaaaaataaacatgtttacaactaattgatcacaacgagctacagatttttttgttccttccccattcccactgcttcacttgactagtcttaaaaacaacaacaaaacagatttcaaggacagaataacttttgggtgaaaataatttagactggacaagtgtgggaaggtttccatgaggaagtaacatctgagctgagatctgaaggagaaagaatctagctaggttgggggtggaggtaggtgtgtgggaacagcattccaggcaggggaaacatcttgtatgcatgaagatctgaggcaggagaaaggaagaggggctatttccatgaactacaaacacatttactttcttctgactagattctaatttgcccacaacttgatggcaagttattttattaatctgtgtgtaatgcttttaaagcaaatctttgctcagattattaggatttaacactcaccgaaccacattattcactcaacaaatgacatttgcctgttctactggagctccctctggacagtggtccttgtcttattcagctccatacctgcaagctcagcaaatgcctaacacataatacttgctaagtatttgcagaagtaattaatcataggagacagcatgacataggaacacaaaagcatgcaaattaacagctaaagtccttagtaataagtactgtccttcaggttggttactttcggaggatatatacacatacatatattcaagtgatgctccaatatgcaaaacaatgtagagttcccttttaacagctgattttagaatccaatgaaaaatgtttcattacctggcagctgcacatcatttttggccctaggctgaaaacagcatttgctacacacgttagccattagctctatgatgctttcccctagctgcccacggcagaatgacgcatacctttccctggactcctggaacaagttagtcaaacctcccttaggatttaccaggtcgtgaggtttatttatactttcatgtctgattcctgggtccaactttgagctcctgtaggattttatttatttatttacctatcttaatcactggagcctagtacagtctggccagataataggtgtcaggtaaatatttgttgaataaagaaacagataaacagccttctatcagaggagcaatgctactcataggccccttttctgagttcttccttccttggaaaggtcttttggggttgagacgactacctcaggagggacacacacagaccaatgctgagaaagggggagggttttctgccaaggcagataagccacaacagcccagagatgccaggtgtgacagatggcacaagtcaatgaactgtgttttgccagaattctcactttgcttaatacgattagtcactgctcctctctagttaaaagctacctcatactctgtggctcagttaaatcagcagtacgagatactaacagcacctacctcacagaattatttctaaggatcaaaatagtaaatatacacaaagaatttagaatagtgtctggcagacagtaaacactcggatgttagttatgagtctgcctccactgttggacttagtatagatagtgctttaataaaataggtacttactggaatttactgtaattttcattaaagttttacttaattttagctttatatataataacatcctatatgtgttaatgcttttgagtaaaaaaatttttttaatgactactatctttctcattttattctgataacattcctaagcaatgtgagtggcctaacttctttcagcaactaaaccagaagtcgacctacaaagctattaagacatcatttgggttaggactatgttcttcagaacagcaagtgagtttcaataaaggaattgagaccactcgtctgagctatttcaataaaaagctttctatgcaggtctccttacagtttccactctctccattcaatatttgttagatactgttaccagatttatgttactaacactcagcttttatcattcttccactcaaagtttttgatttcctactgactacatactgaagctcaaactccttactctgccatctcagctgcctttcagatcttaccctatcctcccctccatgcattctgtgtttaaaaagagacttactttatgtcccctatacgcatctccttcttgcccatttttgagctaatcctctaacaacagctccataatcctctggtgtgtgggcttcctgacctccacgtctctacgcagtggcctatcattctattcagggatcatcatctaaaggcagcacataaataaaaattgggttgtcaaatcaccttggaaaatacctgaagtagcccattaagtacaatactcatgacttacaatcttagaatacttctactgaactaccataaaaagagccatttctctcagggcatatagttgaccccatgttaactgaacatatagtgttacatcactgtattttgatttctaaagcccaactcaaatgctgcttcttgagaaaagtcttctgtgatttcccccagctccatgtactctcaggagcctcagaactagaaccctgcctctgttagggcactgactttatttccccatgtgctgtgggcagaggttggtgcctactttaacaactctttcagattaaagacctcttaagggcagaatttgagttattgttctggcattaactgtgagactttggtaaagttacttaacctccctgagcctcaattttctcattaataaaagaggagatagtatgatccagtaattctatttgtgggtgtgtatccaaaagaagtgaaagtaggggtcctgaagagaactttgtacaattcatgttcctcgcagcattattcataacagccaaaaggtggaagcaaaccacatgtccactgactgataaataaataaaatgtggtatatccatacaatggagtagcaattagccttagaagggaaggacattccaacacacgctacaacagacgaaccttgaggacattgtgctaaatgatataggacagctacaaaaagacaaatactgtatcattccacttataaaagcagtcaaattcacagagacagaaagtggaatggtggttgccaaggtctgaggagagggagaaaggaaaatggggagtttttaataggtacgaaaaagttctggaaaatagttgcacaaaaatgtaaatacatttaacactactgaactgcacacttaaaaataattaaaatggtaaattttatgctatgtgtattgtaccacaatccaacaaaatagagacagaacaccagtctcacaggattacagtagggagtatagtaggatgatgtacataaagcgctcagcacagaacctaggatgtactatatgcctgataagtagcagttgttatttgtaaaacgttacgtgtagctttttcgtgttataatcataatgggtgtgtatatggttatttcctctactgtgattttagaaatacttctgtaatttttataaatcattttatcaattaacagcctcacagaattttacctattgcatcttagttttacttaactatcctcttgtgtatgtatgactagatcagatggcataagcattttttatggctgttattttattttttacataacatgggaaaatattaagactgaacatttaggaaaggaaaactaatgttttaagagtcatgccagcaggcaaattctttatcaactgctcagcatcagaatgtttaaggaataagaaaattcatcactttcataggggtggtgtcttgtggaaaccaaagcacgttgtacccctaatgctttggttggcattaaataccactgctgtacagggagaaatactgctgatcctacccgttggggcattttaaactaatatagttagagccttcctactcaaaacaagaaaatcacttaactgaggcacttttgaaaaattgtaaggctttacgttgtgtgtttgtgtgtgtgtgtgtgtgtgcgcgcgcgcgcgtgcgcgtgtgcttcccccaactttatcttattttcctaagtaacagattcctaatttttagcaaggtacattacccccattcactccccgcaactaaaatgccagatatggtagctcacacttgtaatcctagtacttttgggaggctgaggtgaaaggatcacctgaccccagaagtttgggaccagcctggacaacatagcaagaccccatctttacaaaagaatgtttttgaaaaaattagctgggtgtggtgatacatgcctgtagtcccagctactcgggagactgaggtgagaggatcacttaagtccaggagtttgaagctgcagtggaccatgattgcaccactgcattctgccctgggcaacaacatgggatcctatctcaaaaaggaaaaaaaaaaaaaagacaacattttccggtctccctatcagctaaggtgactgtgtgattaggttctggttagtaaaacataagcagaagttatgtatgcctttcagaaaaatgttttgaaaggaaaaggacatcctttgtcctccatccagctccatggaactgagagaagagtcgccagtccctcagaatcatacatactctagcccttctttctcccaagaagagatcacatcaactactattcctaaaactccctggacatccagaacacagctcacagaggcatctctaaggtctccctccctacataacactagcaaaaagaatctctccctgcttccctggtctagcctggaaaaaaagaatgacccaaacagtccctacagaaccagtgacaccccagaggatctgaagtctctagccctgaatgtgaaatagaaaccatccccctacctgtcctattctgagaggtgtgtccagaagagactgtggatatgaacccattttaggttgcaatgacatcaaaatacaatgggactaatgatctttagagccacagtcaagaaaggatagagtggctggaacacaggggggagaacacttctaagaacccatcctgaagatattcttacacaagtgtacaaagatgtgtgtacaatgaggctcactgcagtattacatgtaagatttaaaagtaataatcataagtatggtatatccatataactaaatactatgtaatcgatataaagataacgaataaaacaagaaacgaagaatattaatgtatcaatgggattatggtggtaactgccagaacaaaaaccagagtggttcaaagtggttacctcaacttttgttaaacaagacgatggccggaacaaagagcacgtaagagacaaaggttgataagccacgtcaacacacttgggagacggaaggcaaatggggtgatttgcagaacagagaaagcaagatactcccgtatgcagagaggtggacacctttgaaaaaagcctaaattccagaaccctggaaaagctcagaactggaggaggcagggaacctgagagtctccaaatctcgagacgagccaaaataaggagaaatgccagactcagaaaactgggtggtaagaccttcagcccctgccccatagttggctccagaaacacggataaaactggcaaaatccatctcctaggagaggaggatttttctctggagaaactaaaaatcccagagaaaacatctgtaaggtacagacattggggcattcttcaccaaaatgactgagtccctgttagtcactctacaataaagtccatcaactgacaaactctgtctaggtacaaagcatttactcagctttgtacaaactgcaaaagctcaacagacaactaaaggatgctttcaacagaaaacagagacagacaaataaatggaagaatttgggagagagagacagggcagggagcaaaagaaaacttaggagaaaaaaacaggaaaaaacttcgattaatatcctcagagaaagaaaagaatatactgcatctaaaaccaagaacagggtgctaattcaaaaaggacagttagagaacaagaaaaaattcttggaaattcaaggtataagatctgaaataaatctggaaaagtcagaaattttagggatgttccctgaaggaagaaccctcccccaccccacacacacccagaaaaaatatgagaaaaacataagaaaattagaggatcagttcaggagtctaatatctaaagggcaggagttccagaaaccaagaaaagaaaaaatggagggaaagaaatgaacacaggaatacttcaagcacacagctctgaactgaaggcacaagtattcattgtgaaatgtcagaacactgaagataaggggggaagatcctaaaaatttcaagttagcaaatactggtcatatgcaaaggactaagaatcagaatggcaacagacttctcaacagcaaatttagaagccagaaaacaacaaagcaatgccttcaaaagtctgaaagaaaataattttcaatctaaacaagtcaaaccatcaacctgtatgagggcagaatacagattttcaaacatgttagaacttataaaatctaccccgtgtatgctttcttaggacgttcctagagttaagagtccaccagaacaagggaatgaatcaagaaagaggaaggcatgagatccaggaagcaggtgaaggagagtcccaggaggccttgacagcaactaattcagcctccaggagacagaaagctgtaagataaatgtctccagaggaaaataaaaaaggaagtaaagaactcaaatgagtttcataaatcttagagtttgggaagaattattaagcaataaccaaacaaatgaaagcaatgatctaactagttaagatcagatctatatttgcatactatacttgtctacaatcactttaatattgatttaaccaataattgtgatgtacctataccttgagcaagggaaactgaattctcatcttccataacatgatgtcagtagaagatataaactgctaaatcagtaaatagcaatataaacctttattttgaaatagaaataagtaggcaaggaaaaatacctaaaaagtgtccagagtggagcagcagcctgctttgtgtcaaaaagctgtgtagtactcttgacttttaaaaatcatcttcacgaattactttactactattaattaaaaaaaacaactggttacctctgaagagggagtctatgtgaaggattggggtgaggaaaactttttccattttgtgtacttttgcaccacatgaactacttttaaaaaatcaaatgcatatatgggttttataatttaaggaagaaaacaaaacattactcctacctagccaaaggtaataaaaactgggacaaaagggaaggaatagacttaagaaatccccaaaataagatctctaagacttggtgacttagcaatgtgttcaatcacatggaagagaaagctcctcttgtatatataaacataagaaaaattacataactaacctatgaaaatttaccttcacaataattgatgtaataagtcgttcagtggcaggttaaatttggaaagttaataacagtaataacaatgttattattattagagacagagtctcgtattattgcccaggctggagtgcagtggtatgatcatacctcactgtacctcaaactcctgggctcaagggatcctcccacctcagcctcctgaatagctgggacacaggtgcacaccaccaggctctggaaatttttgtagtttattttgcagaggcagggccttgctatgttgcccaggctggtctcgaacttccagcctcaagcaatcctcccacctcggcattccaaagtgttgggattacaagtgtgggctactgggcccagccattaattattattttgcccagctttcaaaccaagatggtagctactcattcttttctgttaaatgcaaatggttaagaatatcaatctccattacaggtttctgaccaaattttctcaacacactacaacactgttttaaaagatttaaagttgctcattacagatttggcattataatatttatttcagaacaaactttaaaccccagtagatcccactcgcttctgaaatgactatttttgacaatccttgaacactgaggctttcttgagcatgactttttaccctgcctagatggaaaaaccattctttgaagcagctcctcaaaatttggacttagctgcttcctcacctgatgtgcgagtacaattgcctaagagtataatccaaaaacgacttgctgaaactcatagatgattcatgtctctattctgtcctgctcctcctcaaacgagccagatcttagaggcgtttgttttccccagatacaaagaaaataaaatgaggttggcacctggaagaggcagtgccgtccgcaaagccaaagcaatgtaaccacttgtaccttaactcttctccgttttctccccttttcttcccctggaatctgcttctctcctttctttctctttttccgctttctgtccttgtgtttgtcatgatcgtttttgtcttcgaagaggctggagtcgtgccccgagctgcccgtggagagttcggtgacttcgttccctcctactttgaggaccagcttcaagggcttctctacatactcttaaaaaaagaaaagaaaagaaaggaaagcgcgtcgattaaaatcggggctctccagggagtgctaaggatgcagagcgccaaggcgcagcaagcccgaggcggctttgggcgctccgcgaagcacctgttgaatgacggaccccggcccgggggtgcggcggcgccgcccgccccgaacgctcccaggcctcccgggcccgcctcacgtctccccaccagagacccaccggaccagggggacccgggttcgaatgccgcggccgcacggggggcagcgcggcctccggcaggacgcgcccccttcgccggcctgggcctgccgtgggaaggaagggccccgggccgccccggagccactgggaaagagcggaagcccggcagagccgccgagggcccgccgcccgcaccccggccccctcctcaccctcgtagaggtgtttgtccgacttgtgcttcttgtgcttcttgcccatgtccgaccgggccccggtgcccgccccccgcgccaggcccaggccgtgcggcgccgcttccggtccgggccaggcgagcggagggcgggagcggggcccgcgagaccccgcgccgcgaggcaggggggcggcgcgcgccgggcggcgcgatgcccctctc

SEQ ID NO: 1365 - DNA, 49918 bp, Homo sapiens; identical to SEQ ID NO: 1364

SEQ ID NO: 1366 - DNA, 11108 bp, Homo sapiens
ggaaaaacaaaaaaggcaaatggcaattgcagtgaagaaatgccaagataccttcatgctcaggagagaaagctgtacttcctggatgtggtttccagtcccctacacctctagagaaacctctccactcatgaattatagaaatcatccctaaaagtataaagtgctgtcttatttgtttattttattttatcttatttttgagatgaaattttgctcttgttgcccaggcaggagtgcaatggtgcaatattggctcactgcaacctctacctcccaggttcaagcaattctcctgcctcagcctcccgggtagctgggattacaggtgcccacaactatgcctggctaatttttgtatttttggtagagacagggtttcaccatgttggtcatgctggtctcgaactcctgacctcaggtgatgcgcccacctcagcctcccaaagtactgggattacaggcatttgagccaccacgcctggccaaaagtatagtcttttaaacgtttttaaagatatggataccactggtcattattcactggaataaaactccatcagggttttagcacatttggtttattgctacatcttcagtgtttaagagttcctggtacacaaaaggcatctaataaatatttatacttaataaacatttgctgagtgagtatgccgaatgggttttcaaaggatactgtgataataagtcctcgctaccttcaaaaatagcctccaaattagaggccatttcaacatggaattctggggtgacaattccaggcaaccatatcttcccatgtttttttaagtgcatggggctcctatctggagtgaattcttttctggtgcctaacaaggtatgacctgtcagcgaaggctttaccgcattcagaacatccataaggtttttgtccagtatgggtttttttatgcaaactaaggtttaatttccggatgaaggtttttccacattcactacatctataggtcctctctccgctatgagttttctgatggctatgaaggtttgacttctgaaagaaggcttttccacatctgttacattcatagggcttttccccagtatggatttttttatgttgaatgaggtttttcttctggataaaggtatttccacatagatcacactcataagctctcttcccagtgtgaattttctcatgatcgatgacattggatttctgggaaaaggccttctcacatatgctacatttatagggtttctctcccgtgtgtattctctggtgtttcacaagatctgacttgtaaatgaaagcctttccacagtccgtacattgaaagggtttttgtccagtgtgaacttttttatgttgaatgagggttgagttctgcctgaaggatttctcacattcattacactgataggatttcttggcattatgaattttctcatgattaatgcaggatgatttccaggaaaaggcttttccacatgtcttacactgatagggtttctctttagtatgcattttctgatgttgaaagagatttgacttctgcttgtaggcatttccacagttctcacatttatagggcctttcctctgcgtgagttttctgatgtttatcaagcttccacttctccccgaatgctcttccacagctatgacattcaaagggtttttgacaggcatgcctcctcaggtgactttgaaggcgtgactttgaactgaataactttctacaggcattacatttcagttgttgtcctacaaatttggatggattattgccaactaattttctgtatccattatcatcgtgagaattattttgtacatagtgttgcaaggaagatacatcatctatgcccagtggaagtattttcttagatccgtcacattctacacctttctgcgtagtcagcgtttccttattgattgatgggacttctcttgcgagactctctttcacatcctttggcttccaaatctgccctccaatgtccccatttttttctaaaatggaatacaaaaaaatgtcctgtgtaaaacgttccactcacatgcttgaaataaaatgccataaacaatctattgtggtgattattctggcttcaaacctaatgtctacgagaaaccaaagttaatataagctctgttagagttctatgtgagctaatgttacatgaagctatcacatatctgtctgtaaaggactgagcaacgtagacctagtgcacagggagcaggtgagagcctagggataccagggagagggagattaagaaagagagtttgccaggccaggcacaggggctcacacctgtaatcctagcactttgggaggctgaggcgggtggattgcctgaggtcgggggttcaagaccagcctgaccaacatggcgaaaccctgtctctactaaaaatacaaaaaattcgccgggcatggtggcaagtgcctgtaatcccagctactcgggaggctgaggcaggagaatcgttcgaactcgggaggcggaggttgcagtgagcccagatcgcgccactgcactccagcctgggcgacagagactccgtttccagaaaaaaaaaaaaaagaaaaaaaaaagagtttgcctgcaaaggaaaacccagataagaatgtaaagaaatttctgagtggagaaaaatacctggagatttcttccagcactcccaggaagtcacagctggctgccaaacgacttcctcatttagaaaagctgaattggcttccatgcaccattgacccacagtgctctcctggtcacctacctgcacggccacttcccagcacttcctcttcctccaaccatggctcctttccttgttccaacctcaagatcacatcgggtttggtggtttccccttgtcctgtgatggaagataccgcaaggcttggtgtttgtggatgtgtgagttgtttgtgcaagtgtatgagtgtatataagcgcttgcgtatgcttgtgtgaatatttgtgtgtgagtgtgagcatttatatgtcagtgtgtgggtatgtgccattggttggggggagttgtgtggatggatggtttgagggaatgcacctgagcagtcgaactaaacaaagaatgctttttctgggctgggtgtggcggctcatgcctgtaatcccagcactttgggaggccgagataggagaattgctagagcacaggaatttgagaccaacatgttacatgtaacatgaagatagcaagacccagtctctacaaaaccaaagccacgtgtggtggtgcacgtctgtggtcccagctattcaggaggctgaggtgggaggatggcttgagcccaggtcaatgttgcagtgacgccaggcgtggtggttcatgcctgtaataccagaactttgggaggctgaggcgggccggttatctgaggtcaggagttcaagactagcctcaccaacatggagaaaccccatctgtgcaaaaaatacaaaaattagccaggcatggtggtgcacgtctgtaatcccagctactcgggaggctaaggcaggaaaatcactggaacctgggaggcggaggttgcagtgagccgagatcacaccactgcactccagcctgggtgacagagcgagactgtctccaaaaaaaaaaaatactacagtgagctatgattgcaccactgcactccagcctcggtgacacagccagaccctgttaggagaaaggagataaagaaagagagaggaatggagagagggagggagggagaaaggaaggaaggaaggaaggaaggaaggaaagaaggaaggaaggaaggaaagaaggaaggaaagaaggaaggaaggaaggaaagaaggaaggaaggaaggaaggaaggaaagaaggaaggaaggaaggaaagaaggaaggaaagaaggaaggaaggaaggaaagaaggaaggaaggaaggaaagaaggaaggaaagaaggaaggaaggaaggaaagaaggaaggaaggaaggaaggaaagaagggaggtaggaagggaggaagggaaggaggcagggagggagggagggagggagggagggaaggaagggaaagaaagaaatgctttttcttcttggaggataaagcttttccaaaaatcaagaccaggagtagggtgaagggcagggcacccagcccacaaaacttacagaggccctcactcattctcccggcacttgccgaccctgagaatgggggctccttcaatacagcacttggtacacttcacttgcctcaccctagtcccggctctacaaaaacatatgcgaagtgaggagcacctctgtgccaaccctatttggccagccatggggtgtctgtgtgtttcacgccttaggttttgagtccccctgcccgggaagccgtccttacccacagagacaaggttgctgtaattctccagcatcacatccctgtacaagtttctctgttcgggattcagccgctgccactccccctgggtgaagttcacagtgacatcctcgaaggtcactcttccctgtaacaacagattcccgatcagtataaaaatgccattgaatcctgcggctgaggatacagaaacttgtttctgctgaaccaagctttaatcatgtccataattcactctactctggatgaaaataaattgtgcccagaggatcttgccaatgagccataaaccttagacctactcatgacactgccatctttctccaccctctagtcccaccaattttacttcctgaatctcaaacccagccattagtttccatcttctccaccattcataaatccaccttgtcatcttttacttagagtaaggcagaggccgagtatggtggctcacacctatcatcccaacattttgggaggccgaggcaggaggattgcttgaggccaggagtttgaggctagctggggaacatagcaaaacccctatctcaaagaacattttattattttggccgggcacggtggctcacacctgtaatccctgcactttgggaggccgaggcgggtggatcacctgaggtcaggagttcgagaccagtctggccaacatgaagaaaccccatctctactaaaaatacaaaaaattagccaggcatggtggcaggcgcctgtaatcccagctactcaggaggctgaggcaggagaatcacttgaacccaggaggtggaggctgcagtgagccaagattgcgccactgcactccagccagggcaacaagagcaaaactctgtctcaagaaaaaaaagaaaaagaaaaagaaaagaaaagaaaatgttattatattttttttctattttccatttttctttaagacatcctgcctctattagaaattcttttttaaatagaggcctggcatggtggctcacacctataatcccagcacttcaggaggctgagacaggtggatcacccggggtcaggagttcgagaccagcctcgtcaacatggtgaaaccccatctctactaaaaatacaaaaattagccaggtgtcgtggtgcgcgcctgtaatcccagctactcaggaggctgaggcaggagaatcgcttgaaccctgggaggtggaggttgcagtgagctgagatcacaccactgcactccagcctgggtgacagtgagactccatctcaaataaataaatacataaataagtagaataagccaatagccccctaattcttccagctacatctaaactgactgtaatctattttccacagtcgacattcagactggatggtgcgctcccctaatttatcagctttccttgcatttgggagaaacaggtgacacctgttacaggggccagcgtctggcatgtctaccacactcccactcacacagggtcacacagcactcccctgggtctctcctgcagccatactggacttacggcagcattttgcccctgccactcaacactcacagtgttggaagtcacacttgtaaagcgaattcctttgtcagaaactgaaaatctcacctctaagagccagcacctagtgtcctcttggacagataaattttttagttgtgtttgtgctctagctcgcttttttaaaattttgtttatttattaattttttttggcggggaaggggacagaggctcactctggtagcccaggctggagtgcagtggcacaatctcggctcactgcaacctccacctcctgggttcaagcgattctcctgcctcagcctcctgagcagctgggattacaggcgcgcaccacgacacctggctaatttttgtacttttagtagagacgggtttcaccatgttggccaggttggtctcaaactcctgacctcaagtgatctgcccgcatcggcctcccgaagagctgggattaaagggatgagccaccgcacccggcctttttttttaaatttttgacacaggttcttgctctgccacccaggctggagtacagtggcatgatcatggctcactgcagcctcaacctcccaggatcaagcaatcctcctacctcagcctccagaatagctgggactacaggcatgcaccaccatgctaagctcattttttattatttgtagacagggtctcactatattgtccaggctggtcttgaactcctggcctcaagtggtcttcctgccttcgcctcccaaagtgctgggattacaggtgtgagccaccacacccagccttagtatgcctttcctgtcaacaggaaattggtcaacaggcttaattttaacaattgcaaagaaactactatctgcctaactgcatacaacttatccttggtctttcagctatccataatttactttgattccgactggtactagttaatgatttttcagtttattgtgtggatttacagaatttgtttcaaatacacaccgaacaaagttgggagaggacacacattcaagacaccaatcatttaaaaaataggttggggtgaaacacacatgacactgttacatctcagggcttagcagtggaccaggtttgtaagagcaatggtcaaaagatgcttgaggctgggcgtggtggctcacccttgtaatcccagaactttgggaggctgaggcgggtggatcacctgaggtcaggagttcgagaccagcccgaccaatatggtaaaaccccatctctactaaaaatacaaaaattagccgggcgtgggcgtggtggcgtgcgcctgtaatcccagctgctcaggaggttgaggcaggagaatcgcttgaacctgggaggtggaggttgcagtgagccaagatcaagccattgcactccagcctgggtggcagagggagactgtctcaaaaaaaaaaaaaaaaaaaaaaacaacaaaacaaagatgcttgagctgaaaccagcccagtaatcccatagacagttgtgggttttttgttttttgtttttgtttttgtttttgttttttggataaacatagaaattgacccttccgctgttaaagcttgaaacctgtatttgttttgtctgagttccttcctcaggaaaagaccttcagatctctcaaaggcaggcagatcacctgaggtcaagatttcgaggccagcctggccaacatggtgaagccccgtctctaccaaaaaatacaaaaattagccaggagtggtggtgcgcacacctgtaatcccagcaactcaggaggctgaggaaggagaatcgcttgaacctgggaggcagaggttgcagtgagctgagattgcaccactatactccagcctgggtgacacagcgagactccctcaaaaaaaaaaaatcaactgaaactcaccacaactgaaactcaccacaacagatgtctccttgccccctccctagtcttgctttcttacacattgttatatttcttccatgctgtataaacccctagttttagtgagttagggagatggatttgaggctgagctcccatttcttcacctacggcagctgattaaagcttcttccttggcaatacccattgtctcagtcattggctttctgtgcagccagtagcaggacctagaccaaactcctggtgtttccgtaaccaagctttttttttttttttttttgagacagggtcatgctctgtcacccaggctggagtgcagtggcacaatcatggctcactgcagcctcaacctcccaggttcaagcgattctcccacctccgcctccagagtagctgagactacaggtgtacgccaccaccaccacacccagctaattttttgtagagacgggatctcgccatgttgcccaggctggtttcaaactcctgaactcaagcgatccgcctgccttggcctcctagattgctgaattacaggtgtgagccaccatgcccagccttgagctttacttgaaatgtttcagctttaataggaaagcagaaagtagagtgtgtgttaccttttaatagaagtatggaaggaaggaggaaaatatgccaaaaggttagcacagttaattctgagcaagaggaacgtgggtcatacgtttattcattatgagatttagatttttttgaaaagctcacctgggaattgttcatttcctgttcttcaccagtcagtaaagtcttgggaaggcagatctgagggaaaatggaaaagaaccatgaaatagcagaattcgctttggaagttggggatcatccagcatagaatgctccacaccctggataaaagctctccctaacccactcagaaaagccctgacttgtacctcagtgatccccttctgaaggtcttttttttttttgttttggtttttttgtgtttgtttatttattgagactgggtctcaaagaagaaagtgcaagccaggcacggtggctcacgcctgtaatcccagcactttgggaggctgaagcaggcagatcaccagaggtcaggagttcgagaccagcctgtccaacatggtgaaaccccgtctctactaaaaatacaaaattggctgggcgcggtgactcatgcctgtaatgccagcactttgggaggccgaggcaggcggatcacgaggtcaggagatcaagaccatcctggccaacacggtgaaaccctgtctctactaaaaatacaaaaacaaaattagccaggcgtggtggcgggcgcctgtagtcccagctactcgggaggctgaggcaggagaatggcgggaacccgggaggcggagcttgcagtgagccgagatcgcgccaccgcactccagcctgggcgacagagcgagactccgtcccaaaaaaaaaaaaaaagagagagagagaaagctaaacagcagttcaacagcacctttaaaacaagcctgtgcaaagacaatgaggcaagcatcagatcagctagagcacagtaaggaaggccgagagcagaaaccatgaatcctgaagcagctgtggtcgtgacgaataacgccgcagtgaacatgggatgcagatagcccttcagctttgccataagcgggacagctggatcattggtaattctttgccaaaagcgtagattttggccacgcgtggcagctcacacctataatcccagcactttggaaagccaaggtgggaggatcagttgagcccaggagttacttttttttttttttttttaagaccaagtcttgctctgtcgcccaggctggagtgcagtggcacagtctcggctcactgcaacctctgcctcccgggttcaagggattcccctgcctcagcctcccgtgtagctgggattacaggcatgcaccaccatgcccagctaatttttgcatttttagtagagacaaggttttaccatgttgttcaggctggtctcgagctgctgatctcaagtgatccgccggcctcagcctcccaaagtgctgggattataggcgtgaaccaccacatccagccaagcccaggagtttgagaccagcctgtgcaacatagtgaaacctctgtctcaatgtttaagtaataaagtttttattttttattttattttattgaggcagggtctcattctgtcacccaggctggagtgcagtgatgtgatcccggctcacagcagtttaaaaatccctggctcaagcaatcctcctaccttggcctcctgaatagttaagactatgggtgcatgctaccacatcagctaactttttattttttgtaaagaagggatcttgctatgtcacctaaactggtctcaaactcctaggctcaagcaatcctcctccctcagcctccccaaatcctgggattacatgcatgagccaccacaccagccaggaataaagttttaaataagtaaatatgtttttaaaaagaataaacttgccgggcacaactttaatgtttattaaagtttgaggagtccaattctagcacaaaaaatatatataattttaaaaaacagtaaattgtaaatgctttcaccacaaaaatagattaattagcttgatttaatcatccccccaatgtaaacatgtatcaaaacatcacattgtaccccataaataaacacaattattatttgtcaataaaaagtttttagaagtagctgtgggccagcagtaatgctaaggactggagggccacgaaaataattttgagtgtcctgggagcatcacttttcaatatgacaactaaaaaaaaaatctaaactaccaatgtaaaatatttagcttattccagcaaataggagaggtagaaaaatgaaactaagtaaaaatgcaaaacaaacaaacaaacaaaacccagacatttggttttcagggagaaaaaaaaatcagcttacctccagtggaatctggcataaattagcaagttgattgatttctgatgcctgtggtcttttcttctgaaagggactgaaaatgaaaaggcgtgtatactgaaaagctacactaatgactaaaacttaatcggccctctacccgctgtattccgcatcataatccagtcaagaaacaacccaaaacactcacttcctatcaaaagccccacctgatcctatcaggccacatcaaaatttcaattcccaattctttcctcgacttctccaaaactgaatgaactctcataaaaattgtgattgtgaaagcttaattttcaaatctgcccaatcagtttccaatggaa

SEQ ID NO: 1367 - DNA, 14939 bp, Homo sapiens
agtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacaggtaccccgggtgcagcgcgggcacctgaagccccgtccccgctccctgctgcccagccacccctttgtggtcacgggccgggcctaaatggaacatttggcacccccgtcccctccccaccggcttctactagggagcatggggttaaaagtcgctattgcaaaagtcgtgccactgctcttgagccttatctaagactgataggatgaaggcctttgtagtctgaacactgccccccacccccgcttttttttttttttttttttccgagacaaggtctcagtctgtcgcccaggctggagcgccatggcccaatctcagctcactgcaacctcctcctcccaggttcaagcgattctccggcctcagccttcctagtagctaggaccacaggctcgaaccactaagcccggctaattttttgtattttttgtagagacgggctttcaccatgttgcccaggctggtctcaaactcctgacctcaatgttcctcccacctcagcctcccaaagtgctggaattacaggcacgagccaccagcaccggcctgagcccatttttaatagccaaaaaacatttcaaatgctgctgcagatgcaggcagtttgtatttgggaccagtttgggctgaggtttttttgtttgtttttttttttgttttgttttggtttggtttggtttggtttctgtttttgttttgttttgttttgtttttttgtttttttggttttttttttgagacggagtcttactctgtcgctcaggctagaatgcagtggcgcaatctcggctcactgcaacctctgcctcccgggttcaaacgattctcctgcttcagcctcatgagtcgctgggattacaggcacccgccactgtgcccagccaatttttttgtatttttagtagagatggggtttcaccatgttggtcaggctggtcttgaactcctgacctcatgatccacccagctcggcctcccaaagtgctgagattacaggcatgagccaccatgcccggcctgtgtttcttttttaaaatgtagtttattgaaggaaatattagatcaaacattatttttcttttttccctctctattcatttgcccatcatgtgtaggaccacttacttcaaagcagatagctaccctgggagaaggatgaagatgcaggccatttttatttatttatttagagacaggttctcgctctgttgcccaggctggagtgcagtggcatgatcacggctcattgcagcctccacctcctgaactcaaatgatcctcccacctcaggctcccgagtagctaggaccacaggcatgtgccactacacccgctaattttttgttgttttgtagagtcagggtctcactatgttgcccacaccagtcccagactcctgggcccaagcaatcttcctgcctcagcctcctaaagagctgggattacaggcctgagcccctgtgcctgacaaatgcaggcagtgtggatcattcctggaaaccgcctactcagggcagaggtacagaaagaaaagattgctcttgaaagttgcctgtctttcctctcccacatgggattcttatctgattttttctccttttcagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactggtaagttggttgaagatgtttcatggtccctgttatcagctcttttcttttgcctatgtgtctctccctgtcacattgcatatcctgctctgatctgggggaagtgtatccagccttgccagttcttagccaggtgttttactgtatttgttctgtgcgatgacctttcactcacctctgttaccttcaatagatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatgggtaaggatgaaggctggactcagatcagccagctaccttttcccaggggaggggcggtcaccacggcacccttcttgttaaagcacactgactacacttgtcacgctgtctgtccccactccatatcctcccactttgacccagggtttaattatggatggtcaatactttcctcttcctctttgaatgaggggcaacattcctagtttttttttgggggggggggtgtttttgtttattttttgttttgtttttgttgagacagggtctcaccgtgttgccctggctggagtgccatggtgtgatcacggctcactgcagccttgatctcctggggctcaagggatcctcctgcctcagcctccctagtagctgtgactacaggtgcgtgccactatgtccagctagtttgtattttttgtagagatggtgtttcaccatgttgcccaggctagtctcaaactcctgggctcaagagatccacccacttcgacctcccaaagtgttgggattacaagcgtgagctaccacgcccagcccattcccagttttgtttggatgctggggcactctagttcctgtctttccttaataccttcagataaccatggaaagttaaagacccagttatctgccttgggtcaggccaagaccttaattttcaaacaaaacaaaacaaaacaaaaacaggtgcctctcttccttgaaagtgaaaactagcttttggatgtataaagcatcaaccaggaccgtctttgtttactgcacaaaatagaattcatgatggaatttcatgtgcatttgagtgtgatgcgtttatggccctgcgaattctaaagaagggatttatcactttctatggcccaagggaataggcttaatgtaattactgatagagaaagaagtttcttgttttcactgagcccatgggaaaaaatatcaggaattcctataatcttgggacattctttctcaacccagaactgggacctcaactttttttttttttttttttttttttgagacaaggtctggctctgccacccaggctggagtgcaataatgcaaacatggcttactacagcctcaatctcccaggctcaagcgatcctcccaccttagcttcctgagtagctggaaccacaggcatgtgccaccacacctagctaatttttatttattttttgtagagacagggtctccctatattgcccaggctggtcttgaactcttgggctcaagcaatcctcctgccttggcctcccaaagtgctgagattacaggtgtgggccaccacgcccagccttaaacttctttatttttaaatgaaagggaacaaatttttaattcacccagaagtatgactgtggtaaagtgactgtgacctctgagggtagaatggggatggggtccccttgccttttctagtctcttttgcagcagacacacatgccaacctgtgatctgaaaagcccgcccccaccaccacccgcccccaacccatggaaaaagctgtggtgtcagcagtagcttagagagctaccaagagaagtctcaggctgcaggttgggatccccaatgagagtgtgtcctacacattccttgggacccttgatggctccaatcaaagtgtgagcagggctttgagctaagggtggctcctgaagctcccattatcttacactgaaggggtgcttaggaaatgctttcaaaatctattctgataaatttatttcctgtgaccattcaccacagcaatcaatctctccacttaaaaaaataaaataaatttaaaaaaaaagctttcttggccgggtgcagtagctcatgcctgtaatctcaacacttttgggaggctgaggtgggtggatcacttgaggccaggagttcaagaccagcctgaccatcatggtgaaaccgtgtctctactaaaaatacaaaaattagccaggcatggtagcacagcctgtagtcccagctactagggaggctgaggcaggagaatcctttgaacctgggaggcggaggttgcagtgagtcaagatcacgacactgcactccagcctgggcaacagagcaagactccatctcaaaaaaaaaaaaagttttcttatacatggaaaaatattaaatgaagaaaacctaaaatttaaaaacataaaatgtagtaatataatgaagagatgtgattgtactatctctgcatctacattcctatctgtttattattttttaccatgcttacttccaaaaaaggatctgagaaacaatttgcaattaaatacatataaaatagggccccttagaaaagacgaatcctgggcctggcgtggtggctcacgcctaatatcccaacactttgtgaggccaaggcgggtggatcacctgaggtcaggagttcgaaatcagcctggccaacatggtgaaaccccatctctactaaaaatacaaataaaaattagctaggcgtggtgcatgcctgtaatcccagctactcaggaggctgaggcaggagaattgcttgaacccaggaggcagaggttgcagtgagttgagattgcaccattgcactccagcctgggaaacaagagcaaaactctgtctcaaacaaaacaaacaaaaaaaaaaatgcaaatcctggattggagagggagagagatgtcacaaaacctagttgctgtaaataaactcggtttgtgtctctgaattttctggagcattttctggcaaaatggggcatcactcgctctgtgatgactgtcctggtgcccctagattagaaactcctcctctgaactggatgtggcacctgccccatatcatggccactgggctttcacttctctgcttttcccacaagactgggagcttccagaggagttgggtttttttcacatttctatctattgctgcccagatcagcacacaaaattcatactcaacaaatgtactaggttacatagccttccctactcaacagaaggaagagagcgctcccattgtcacgagagctgggctcccgctctaagagatgccaggtagcacagtgatctcagtggcctcagccactaaactggtactgttttttaactgttgctttacctctacagatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggtaagatttctcttaacacctacttattactgagccttggaggaaatactttgacatacaaagttctcactactgaccagggtggtggctcccgcctgtaatccagcactttgggagccaaggcgagtaggtcgcatgagcccaggagttcgataactgcctgggcaacatagtgaaaccctgtctctaccaaaaatacaaaaaattagctgggcctggtggcatgcatctgtgttcccagctactcaggaggctgagttggaaggatcatctgagcccaggagtttgaggctgcagtgagccaagatcgtgccactgcactctaacctgggtgacagagtgagacccggtctcgaaaaaagaaagaaagaaagtaagtaagttagttagttctcactacctcaaaagtgttatttataatgaatcttgggttcttcttttattattgcctgagtaagttgtaggacaaaaaaaaaattctatgataaaatcttcatttgcatttccatctctagcagagactaaaatctgtatggtattttggtggtttaaatgagttttaaatacaggggttttgttgttgatgtttaaatcagaaatattttcaaatttacagagaaaaataagaatagtacaggccaggcgtggtggctcacgcctgtaatcccagcactttgggaaggccgaggcgggcagatcacgaggtcaggagatttgagaccatcctggctaacacggtgaaaccccgtctctactaaaaatacaaaaaattagccgggcgtggtgggcgcctgtagtcccagctactcgggaggctgaggcaggagaatggcatgcacctgggaggtggagcttgcagtaagctgtggtcgcaccactgcactccagcctgggcaatagagcgagactccatctcaaaaaaaaaaagaatagtacaaacaacacttgtataccttttacccgggttcacctattgctaacattttgttccatttgctttatcatttgctgtctgtatatatctaaacatctttatctccagagtcctttatttaaaaaaaaaatagagatgagatctcactatgttgcccaggctggtctcaaactcctgagctcaagtgatcctcacacctcttcctcccaagtgctgggattacaggtgtgagccactgcacctggcctatctccagaatcatgtgagagtaggttgcatgtatatcctatgtgcctttacccctaaaatgctgcagtgtgaatttcccaagaaagacgacatattcttacatgaccacagttacagtgatcaacttagagaagtttagcattgacacagtcattttatctgatatactatctaaatcccagttttgtcaattgtacaaaaagtgttctttctcacatttttccctccagcacaggatgcagtctaggctcatggattgcatttccttttcatatctctttgatcttttttaaaactggaacattttcatagctttttttgtttgttttttataacattgccatttttgaagaatacagccaggcctacccaactcccccttttttaatagggcattccttatttagtatttgtctagtgtttgtttgtgattaagttgatgttatacattcctgactggaataccgcatagataatgttctgttctcagggtaacccatctggaggtacacgatgtccgtgtgtcccctcgttagtgattttgatcaccaggttaaggccctgtcagatttctctactgaataactatttttaatgcaatttataagcaatttgtgggggttgttagttatctattgctggataacaaattaccctgaaacttagaggcttaaaataagaaatatttattatctcagatggtttctgaaggtcaagaatctgggtgcagcttagctggatggatccagttcaggctatctcataagactgtagtcaagctttccacaggggctgcagcctcggaaaaggctggattctctgcagaggtctgaaagatccacttccaagctcattcacataggggttggcaggaggcttcagttccttagctggtgggtctctccacagggctgctcaggacatggctgcccctagaaccagtgataacaggagagagagagagagagagagagagagagagagagagagagagagagagaaagagagagagaacgcatgcacccaagatccaagatgcaagctacagtctttaaccaatcggaagtgacataccatcacttatgccatatgctattggtcacacagacaatgacagagggaactatccaagggtgagaatgctgaaaggtgggaatcattaggggctatcttggaggctggctacaacatggggagatactctaagtccacacaaatatcctggtcctcatcaaaatttcttccttaagttttacattcattgatgattctttcttgaaccaaagtttactatgatggttgcagaatgacttacatgcaggtttaaaagaattttatctacagttttaaattagatactgcacttcacatatatttctcatcataataaccttctgagttagccgaagttgattctccatctctactattcccaccttcccacactgccgcctcacattgttggccctgctgtcctggccctgtgcaacttcaatatggaaggcaggagaggtcagagcagctgactgtagactgcttcccatcttcctggactttatacaaccacagatatggtccgggacaggttgaaagattaaagatgagaatctgttggaagcccttctgcagtaatttctgcaagataaagatatgtgattggatatttcacctcctggtgaaattgattttctctccttcttttaagtagaagttgacagttctgtgctcgcttcagcagcacatctactaaagttggaacgatagagagaagattagcatggcctctgcacaaggatgacatgcaaatgcatgaagagctccatatttttcttacaaagtttacagttctgaggcactctgtgagacaaaaataaagatggcctccaaggcctccattctaagcatggagtctctgggccatcaggagacctcttaaaattgcaggtgtcattgtaggtgtaactattaggtattactatagtattctatagtactaataccaatactataatattatacttataataatatatagttttactttatgtattatcatatataattttaaattatatattataatatagtattataattatataagcatatataatataatcatattatatataaatataattatatattatataatatataatacaactatatatattatattaatatataatattatattatatataattataatataatactgtagtattctggcagatgcataacactagtacactagtatatacctgttaggtatatactagtgctatgcatctgccagaagcacctgagactctttctcaagagaggtcatagctcttggcaggtgctcggaggtgccccaggcccagaaaaaggtggggttatcttatagtctagatggattctcaaggtgatcgcaccctgaatatatcaccacacccaagatctgacctgtctatgcttgttactagataatgaagccagggctctagattattctatccaccaaggaagaggctttccaagcagcaggagattcacatgcatgttccaggcctctttttctgtgaggcagataatgtgcagggagagtcatgaaataaacccaactgccctagagcaggaaactgccgagggaacatccttctccccagggagggaggatcgaccctgtcttgcttgctattcaggcttcccatctacattgtctctggcatctgtgccatctcattttcggcatctgttgattctcttctcctatgtgagttgagatttccatgtttctttgtgttgccaagtaatctggggttgtgttctagacattttgaatattatgaggccctgagtcttgttgaaatcctttggccgggcgcggtggctcaagcctataatcccagcactttgggaggccgaggcaagtagatcacttgagctcgggagtctgagaccagcctgggcaacacagtgaaaccccgtctctacaaaaaaaataaaacaaatgagccaggcatggtggcttactcccatagtcccagctgctcagaggcggaggtgggaggaatgcttcagtccgggaggttgaggctgcaatgagctgtgatcacgccactgcactccagcctgggcaacagagcaacactctgccaaaaaaaaaaaaaaaagaagaagaagaagaagaagatagaagaagaaggagacggagaaggagaaggaggaggcttggcatggcagctcatgcctgtgaccccagcactttggaggccaaggcaggtggattgcttgagctgcttgagctactcgggaggctgaggtaggagaatcacctgagcctgggggaggtggaggctgcatgagccgagactgcattactgcactccagcctgggcaaccaggcttttcagagttccaagatggctgtgccatgtattttatccaggttttatagctgtgctcagtgggagaaaatgaggttcgtgcatgtttactccttcttatcttgaaccagaacttctaggcacagttttaatttgcattatatgcaagataattgtcattttatatatatataagtatatataatataaaattatattatataattataatataatataatatataatcatataatataatttatataatattatattatataaatataatataaaattatatatacatatattatatatacttatatatacatattatatatacttatatatacatattatatatactcatatatatacatattatatacacttatatatacatattatatatactttatatatatatatatatatacacacacacacacacacacacacacacacacacatatatatatatggcccagattggaattgtatagtgatttcctttgatttaatcactggaaaggatccctggtgagaaaggatggtgtcgtgcatggggtaagatgctatggggcagagctcagtgctctttggtttttgtaggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctgtatgtatttttcattatttgtctcagtgctgccactattgttttcatatgtttgtgactagtaaggcgcctctccctcgcctcatgtgaagaagtcttcacttaaatggagagctttctgatgctactattctaatatagtaacgacagcacagacttgactgtgctgccaatcaaatcatggtcctcaacatatttaaatatggcaagagtttggcataatatggatagatctggggaagctaataaaaaataattaatacaaatatgggtagattctcaatccttttccttgccatcatcaccagaaagaggttcactgcaaaagagatcctattctaccaggaggtgcctaaaggcagataatacttaatggagtattggcgcaaaagagcagaaaacttgaggtttttgattgctatttcttgtttgtactttagttaaccataggcaagtactcagaagctaattaccaacctttcaaaatggaaaagcaaaaaaaaaaagtaattgcacgttgtccaactccatcaatacgcttgaaaggagccatagttggaaactgggagggaaggaattatttagaatctagaagggagtccttgaaactgtttcatgaaaggtgccaaaccttttatgaaacaaaagagcaacattaataataaaaatgacttggaaaaaatatccccagaactctgcatgcagatttaatcagaggcaaactattctggtgcagatgttttgctttgaaatatgtagtgctcgggaggctgaagcaggagaatcgcttgaacccgggaggcaggggttgcagtgagccgagatcgcgccactgtactcctgcctgacgacagagcgagacactgtcaaaaaaaaaagaaagaaagaaagaaaagaagaagaaagaaagaaagaaagaagaaggaaagaaagaaagaaagaaagaaagaaagaaagaaagaaagaaagaaagaaagaaagaaagaaagaaagatgtagtgctcttttttatgacagtttttacccattgtcattgtatgtggttttaacatttttccattatacctcaatctaatgactgtagtgacctggactttgtagtataaagttttggattttgatatttgttttttgtataccacggttacccccctttaagggcacctagtttgtttctgagtgcccctcctgcaagaaacaggctcttctaatatttagtcttgaatttggagcactcagtcaggcagaaaaagaattcatgtatcttgctagtttttgtgcatgaactgttcacgtggtaccattaagttgccttgcggatctcaagagttttgtaactgaaacagcaaaggtctaaccacaagctgacatgtacttgacatagacatgcagggccccagttcaggtcagcttcaaaaagaagtattattggtattttagtaagaattctgctttcttttttctctctccatctgaatgcttaaacagatatgcctgtacccaaacaaaagacaatgaatccatcccaatcatgtggtaaaaatcctttgttcacatgccagacactggataagctgaagtgatctgtatttataaccagcttgagagctctcggtttgattctcagtatttagtggcctgttgttttgttgtggttctgtttttgtttttgccttttaaccatagccaaccgcagaagtgtttacaagctagaaaaggaagaacaaatcccagatggaatgtgtattgatgctgaggggaagctctgggtggcctgttacaatggaggaagagtgattcgtttagatcctgtgacaggtaggcctgcagcaaaatgaaaaatccttgtcatggctaggcagagatatagcccgaaagttacagtcagaatttcttttcctgtagaggtgcgactttttgctcaaaataaattgtcagggaaagtagattaaatattaaatgcacagatgaatcctgacctccacagtcttcttagatcttccctagaaacaatacacaggttggaaattgctacaactaaacttaaaataaaatatttggtggtctagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaaggtgatatggctatttcttttattttgggggtgggggatcccaaatacttacaggggtaagtaactgagtgattggtacttttgcatacttccaaagcataatcctatttagcatgttaagctcatcatactagactgaaaaacattttatttcaattttctagagagtaagttatctgaagtccaagatgatctgtttagcctactttgtacattaatttttttacttcctgtttattgaaattcttcagatcagtagaatgaacttggaaagccagtatttacaacatgcctagaagatcagttgattgttttgatgtcttaaggatttttcagattttaaacatcttttggcagcagaataaacactgataaaaatcgtagagcttttgagctgaaaagaaatacataatgtagaaacccctttcttagcaggcggcagatgataggagtaatccagttttaaatctaagttagtcgtaaatgattgctagttgaattattaactatatgaataattgggttggaccataaatatccagtcaggtaattcctttttatgataggagataaaacaaagataataggtggctaagtatattactacaaatcataaaaatgcttttgaagaatacttgtgaattacctttcacctgagattccctcttttctttttcaacagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacc

SEQ ID NO: 1368 - DNA, 14939 bp, Homo sapiens; identical to SEQ ID NO: 1367

SEQ ID NO: 1369 - DNA, 40648 bp, Homo sapiens
gcacaaagaaacagacagccctgtatttctaaaaccattcaaggctccttcattaattggcttccccccaaaagaaagatttctttattaagaaataccagagagtgaaaaacccccaacacatacacatttgtaggctcacacaaaagtgcagagatttacatattaaattgcatttaaattagaaaatagatttaaaaacaaaatactttttttctccaacaaagtaaagagatttggtcagtaggaacgggtgctttatgggtaaaggcaggatggtcaggacagggagaatggaatttagctgctacggaatcagaatccacctctaacccaacctcactcctggggtaaaagcaaaggaggagatgatgatctcagctagggccaggaaggcctcagagctgaatggacatgaagaaatggctcaccacagccaatttccacctgcccccagaggtttgggatcagtgccaaccatcctggcctgggaaagtagggtgcataggaagcttgaggaagaaggaggaaggggagagttggagacagtgtcagccattgaaaagaccaaacaatttaaggcccttttcccctgggaacattgattctttaatctcccctctgatcagatagggacagtcccagctggtgcatggtatgaatgggacagatcttcaggccaacatcttaaacatggaagatttattaaggaaaagaaagagggcagggagtatgaaaaagcagaaaatcatttcacactagagataagagatttccactttgacccttcccatcagaaagagaaagcttctctgtctgacctaagggtcctcaggagaacacttgaggtaaggtgagggaggagagagagccatctgagcccaggagaggagatgggctgagtacttattaaaatggggttcatatgagtgccaagttacctggggaaacctaacaacttacaaattctccaggtttggctttataacttcaagaaaaaaaactgagagaaccagaaaaagaagcagacaggagagggatctgagtcagtctctccccatctctcttccaatctctctctctctctctctctcaagaatgctcaacttaaatcctgttaaaaggaaaaaggaagacatggaaaaaggtctgggagcagccaaatttcattaattccaattaactgggaagtatgagatgggaattgatagggagtcttgattatacaccacctagaaagaaatatataccatcacttgtaaaagaccactgatcaaatatttccaagggggggccctgatgagcctgcgttaataactaagacttattagcaattaacggcatccatctgcttcaaaacaatatcctaatatagagcttgttctcttaagtaaatataatccctctaccttcctgatcctgttcacactatatctccttgaaagtcctttcttcatagtccagaataagaaaaccttcagcccagaatgtagtatagatcaatggagagtttggaactacctctccaacccaagggtgccctggttaatggaagtttggggagtaacaagcaaccccttccaacccccacccccaccctacacacaaacatattcttgaaatggaagggggaaggaggaggcaggaagtttgcattagacacagtttaatcgccttcaaatagatgaaaagttctggtttacactcccccaccgcataagtcatccagacaggaccctggcttagaaagaggaaaacacaggtgctctaggaaatatagccacatataatacataaatcttcttccctgaaatagagcaggtcctgagcagagctgactgggggccacagcccacccccagggtgaagtggctctgggactctgccggtggaagtgctggaagagcggggcttggaggaagcccccagtgtggttaccatagccagaggtgggccgaggccttagggtgagttacccgagagggcagcagtgctgggctttccctcactcagccgaggcttaatggaagaactggttagcatttttttttttttgagggtacatcgggggagaggagaggagaggagagcctctctgtgccttggtttcccatttgtgcattcagggcctctgcaggcctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgccgctggcatctcataaattcttattgagaatggcacaggtattaaaaaagtttctgggtagtctacgagaaatgtcaattattatctctactacaactacttacatatatctaatgggaaaagagtggggcttaggtgtcagagtggatgggagacaaaggagaagctacactaataaatacaacaagtggaaggtacctgtcccattcctaaaaggatttgtgggcaatgctggcacttggtggccaggagaatcttctgaccccactctccctcctcttcagtcctgaagaccccaagaacccagttaggatcccctggccagaggtctctgtgactgcctctggactcagcacgtgcagcagcttgggaggatttgagccagtctcaaaaacttttagccccagaatgagaccagtgaccccaagcaggagggctgggatctggagggaagagagggggtccaaggggaccctgtggctgaggccatggagaaccagtgccagggcccaagagacccatttttccagttatcagaggtgactgacatcttctgccactgccttgagttcagaaatttaaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcagctgcctcctgtggtggctctgggggctctggaggtggcatctcttcgggagtgctgctgtcctccggcatctcatttgagttcaggtgttctgtgggggcctgagaaggaaaagatatgagattcaacacaaagctgttcctcaaaatccaaatgcagataaaccttagacactgaactcttcctctcagccccctgatcacactgatgctacagatatgcagccaccaacaccaaactcagaaccaacaccaagctatcgtcttctcggcagaacacaactgaagtttatttgagtttgatccttaactgttggttggggacagatttttctattattattaatagtcataataataggaatcacaaataattacacaggtcctccccacttcagaacaaatgtcataacatacttatgtaacaaggcctgacccaatggtcctcaatcgtgtttctgcccgaacacacagctcattagaatagtgattctgaaccaaagaaggccaagtgtccaaattttcagctggtcatatgtggtttgaaaatgtccccaagtgattctaaaataccacccttctccactttgaaccaagaataactaacctagattgttacaatttgagtccagactcatttaaaaaataatattaaaaatgacaacaataatatataaacacgggttgctgtactttaaaaggaaattcaaaatttaggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcatgataactagccaattatattgttatgaactgtttatatttctcctggaatatcagtgctttttaaaaaaattgatttgtatgagttccttatagttaagagtattaataaggaaaggaaatactacctcacatcagacctttttattttacttaagttctggggtacatgtgcaggatgtgcaggtttgttacataggtaaatgtgtgccatggtggtttgctgcacctataaagccatcacctaggtattaagcccagcatgcattagctatttttcctaatgctctccctcccttccccacccctcaacaggccccggtgtgtgttgttcccctccctgtgtccatgtgttctcattgttctcgaaagaagacattcatgcagccaacaaatatatgaaaaaatgctcaacatcactgatcattagagaaatgcaaatcaaaaaccacactgagataccatctcatgccagtcagaatggcgattattaaaaagtcaaaaaacaacagatgctggcaaggttgcggggaaataggaacgctattgttgttgggaatgtaaattagttcaaccattgtggaagatgtggcaattcctcaaagatctagaaccagaaataccatttgacccagcaatcccattactgggtatagaccttcttcttttttttttttttgagatggagtcttgctctgtcacccaggctggagtgcagtggcgcgatcttggctcactacaacctccgcctcccgggttcacgccattctcctgccttagcctcccgagtagctgggactacaggcgcccaccaccacgtcccctaattttttgtatttttagtagagatggggtttcaccatgttagccagaatggtcttgatctcctgacctcgtgatcctcccgctttggcctcccaaagtgctgggattacaggtgtgagccaccgcgcctggccagaccttctttaaatatcaagtttcctgcttcacttaaaatgggtttcgacagccgggtgtggtggctcatgcctgtaatctcagcactttgggaggcctaggtgggtggatcacaaggtcaggagttccagaccagcctgaccaacatggtgaaactccatctctactaaaaatacaaaaattagccgggcgtggtggtgtgcacctgtaataccagctactcaggaggctgaggcaggagaatcgcttgaacccaggaggtggaggttgcagtgagccgagatcatgccactgcactccagcctgggtgacacagtgagactccatctcaaaaaataaataaataaaatgggctttgacaatagatgctgatgaggctgtggagaaataggaacacttttacactgttggtgggagtgtaaattagttcaaccattgtggaagacagtgtggcgattcctcaaggatccagtaccagaaataccatttgacccagcaatcccattactgggtatatacccaaagcattataaatcattctaccataaagacacatgcacacatatgtttattgcagcactatttacaataccaaagacttggaaccaacccaaatgctcaccaatgatagaccggataaagaaaatgtggcacatatacaccatggaatactatgcacccataaaaaaggatgagttcatgtcctttgtagggacatggatgaagctggaagccatcattctcagcaaactaacacaggaacagaaaaccaaacaccgcatgttctcactcataagtgggagttgaacaatgagaacacatggacacagggaggggaacaacacatactggggtctgtcggggggtggggtgaggagggagggcattaggacaaatacctaatgcatgcagggcttaaaacgtagatgacaggttgataggtgcagcaaaccaccatggcacatgtatacctatgtaacaaacctgcacattctgcacacgtatcccagaacttaaagtaaaataaaaaataataataataataaaatgggttttgatttataaaaatcttatatacatatagtagctttttagtatacacgctgccgaagagagcaccatatagcttttaccatataaagcaatatatatctcccaacctttgcctaaagaaatggctagtaagaggaaagcaatgccctcaggatgccacatggtatacagaaaaaacattatccaatcatgggaactcaagaaaaagtaattttaaaaagaacattagaagtatgcctagtgatgatataagcaatttcacatataggcctatcaacaggaatctttatggcccatttctcatcttggccagggtttagcacacagtaggcagtgattacaacaaagccacatatatgtggatggaagtacagaccactgtattagacacacatatacctgaccctcttgcagcagcagcaaagagaagaaataagcagtttggaatcagacctgctctagcttaatctcatactaattatgtgaacttacatactggtgcttcacctatttcctcatccgtaaaatggggataataccaatctcatggggctgttacaagtcttaaatgagagaaaggtaaatcacttagcacagtgcccaatatgtagtagaaactcaataaatgctagcaactttcctcttcttgggttgcgtcttagacagaccttccttcctcaatgctgccctccagtggactaggtgtctcctcccactatgtaaggtgggtcccacatgaaaatccagtacaggaaaatctaaatttcaaaaataggtaaagtttatttttctcatttactaaagaggtttttgtaaagtttaggctagaggatatttaaattttgatttgatctacacaagtacagctgatttgcagtttttcaggagcttgttgcctatctaaatttccctatctaaatctagttcatttctcatctaaatctatcttccctcctcccaaaattggtgaccaccctgactttctagttcaactcagccttttccctaggcaatgtccctgtagttttactcacccacacagttgtcacagatgctgcaatgggaggcccggggaggccggaagatcttgcatgtgtaacagtatttcagtttcacaatctggttgtttatctggaaattcttgatacgaggcggtggtcgctggccctggggcaccgcaccattggtagcttctgtaaatcaataaagacagttaatatcacagctagccatcacttgagcccaaaagtctcaccacctctccaaaaccaatgggggcattcaaaggttccccaagccccctgtcttttatagactagacactcaacatcacagaatatgcccataaaactccactaagtgcatgcagttctgttgtatacataagaaaaagtgtttcttcgaggcttttttttctgattacaaagaaaaacattcatttaaaaaaatagctaaaaatacattaaatgaaaacatccaatttcactaataatcagagaaataaaaattaaagcacaaagataccatttttacctatcatattaaaaaacattacaaacaataaaaataccccatgttagcaagggtggggaaaggtcattcttagatcttatcagtgagcaatatggcagctgctactaaactttttttttcttttaagatgaagtctcgctctgtcgcccaggctggagtgcagtggtgggatctcagtcttggctcactgcaatttctgcctcctgggttcaagtgattctcctgtctcagcctcctgagtagctgggattacaggggcccaccaccatgcctggctgatttttgtatttttaatagagatggggttttatcatgtttgtcaggctggtctcagactccagacctcaagtgatccgcccgcctcagcctcccaaagtgctgggattacaggtgtgagccaccgtgcccagccagctaccaaagttttaaacgtgtatattcatttactgatcaagtctacttctagaaacttatcaaaattataatgagatatacgaaagatgtttatataaggatatttgtcacagagttccttttaatagtgaaaaactaaaaataacttcaatgtcacaatagaagggtggttaagtaaattatgttatgtgcatagaatggaatattatgcagccgttaaaaatgacatagacgaaagaatggtgaaaacaggaaaatacaatatatggcaaaatgaaaatgtatgttaaaaagcaatacgcataaaacaatactatcttgcaaacaaaatatatgcatgtgaaaagaaaagactggtaacacagaaacagttactgaaataaaagtaatgcttgcttattgtaaaaattttggaaaaaaacagaatagggccaggcatggtggctcacgcctgtaatcccagcactttgggaggctgaggcaggcggggcacctgagatcaggagtttgagaccagtctggccaacatggcaaaaccccgtgtctactaaaaatacaaaaattagccaagcatggtggcacgcatctgtaatcccagctactctggaggctgaggcaggagaatcgcttgaacctgggaggcagcctgggtgacagagcgagcaagactccaactcaaaaaaaaaattttttttggaaaaaaacaaagtataaataagaaaacataaaaatcactgacagtcagtctctcagctcagagatatttatattttttggcgtatttccttctaatcttctattaacaggtaaacattcataatttttaaaaaattgagatcatattataaatgcagatttgtaccatgaagtatttacttaatattatatgctgtgaacattttctcattgttaattttttttctaaaacataactactggcaatattccatcatatacgtgtactatgatttatttaaatattccatattgttgggattttttactatttaggtgatgtttcatgtaaaaatttaaaacattacagagaaaagcttaaatctccttcgatcaccacctcaatcctagtcccctcctcccttccaagaacatactcatgtgttaaaattaatttctaaaacagaaagaataaagaaaagaatggtgaagtataagcagtaatacatgaagttgccggcattaaaatagctactcatatttaaaagaaaagaaaaaatgatgcaccaaaaatccttctacagtaatttgtaaaaatctgtttatctcctttagctaaaccctcagagaagtagaactactgggtcaaagggtatgaccctttaaagtccatattacttgttgccaaactgcttcccagacagaccgtatgaatttgcatgcctgcccatccgcagcatatgagagtgcctgtctcattgcactctcaccatgcagtataattctaaaaacagaatatttttcaattcactttgattttaaaaatatctgccatatggaacatttttcctttttttgtggagtggggtagatgctgtgaaatcaaacaataacaatgtgtcacaagtcttaaaaggatgaggacagctattcattagaggataagtaccagcatgccaccttaatattctatgcatatgctttccatgagggcacctgggagacagggttcatggttcacctttctcaggaggccgtatcaggcaagggcatcacatgacttcctctctccccatcccccacccacagcatacccagtacaggactgaatataagatgacaaaaacttgctaacataaacatacatatgaactgaaaaatgtactcttctagtgagagaaacatgctaaatgcagaggccacaatgtgactgcttgagtctgagccccaggcccagtgatcaggcagaaaagagctaactttgttaacaacctgctgtgagaggcaggagacaagtcaaggtactgccttgaccctcagtttctccatatgtgaatgggaagggaactggaaaagaataatccagatggagaaaaaacagcactcacaactcttcctcaccatcttgctcctaactactcctagttctatcgggtctccccagaactccagctgtgccagcacacgtcgcctctgctctcttcccactatccccaccctcaccccacccccaaatagttatagctcacatgtgcacaaacccatttctccttagctcaactaaaacaggctggaatttttcaaaatgaaatccattaagaagcctaagggaaaacacagctaaaataaacaaaagaaatacatgggccgggcgcagtggcttacgcctgtaatcccagaactttggaaggccaaggtgagaggataacttgaggtcgggagttcaagactagcctggccaatatggtgaaacaccgtctctactaaaaatacaaaaattagctgggagtggtggcgggtgcccataatcccagctactctggaggctgaggcacgagaatcacttgaacctgggaggtgggggttgcagtgagctgagatcacgccactgcactccagcgtgggggacagagtgaaactgtgaaaaataaaaaagaagaaaggaaggaaaaataaaaaagaagaaaggaaggaaaggaaggaaaaaggaaggaaggaaggaagggagggagggagggagggaaggagggagggagggagggaaagaaaaagaaaaaagaaatacatggaagccttcaaagcaccgtcaaagaactaaaggctagccacagattggtgctctactggcacagcttcttagtcttacaagtcctgggtccctttttcttactctgtctagcttggatgctgactcaagctacctgggtaccaaacctgagaaccatttaggtaggcactgctgttgatctggtgggctcccactccctcctagtacttgcatcatagtcttctttctcactgtgagatcccaggatatctcctcctctggccctgggatggttctgcttcaaatcatgaagccaccctggctcctagataatgtagcacttcatctctgtaccaaagatccttatcctgagctgcagtatgcactctactgagcctgcaattgcttcttttacccctcctagaattctcagtggttcctggcaccacagctgccccctttcacattgcatgttcccctaaagcagcgttttttgtttgtttgttttggtttggttttttgagatggactctcgctctgttgcccaggctggagtgcagtggcgcaatctaggctcactgcaacctccgcctcccaggttcaagcgattctcgtgcctcagcctcccgagtagctgggattacaggcacatgccaccatgcccggctaatttttgtattttaagtagagacagggcttcaccatgttggccaggctagtcttgaactcctgacctcaagtgatctgcccgcctcagcctccccaagtgctgggattacaggcgtgagccacagcgcccggcctaaagcaggaattcttggttgggggggacatgaatgaacttcagaagatctatgaatccctgaaattacatacaaaattgtgtacatgtacatgcatataagagcatttttatggggagaaggtttacagctttcatcaaaaaaccaaaaagtggctcttgagccacttgctcaagccccctcccactctgtggagtgtacttttgtttcaataaatttgtgctggccaggtgtggtggctcacgcctgtaatcccagcaatttgggagatcaaggcgggcggatcacaaggtcaggagatcgagaccatcctggccaacacagtgaaatccccgtctctactaaaaatacaaaaattagctgggtgtggtggcatgtgactgtaatcccagctactcgggaggctgaggcaggagaatcacttaaacctgggagtcagaggttgcagtgagccaagatcacgccactgcacttcagcctggtaacagagccaggctctgtctctaaataaataaataaataaataataaatctgtgctttcattgcttcagaaaaaaatgtgttggtgaccacctcccccaaaaaagtaaaaaaccatcctcctgggaacaatacagcaggaccttggtaacaaatccttcctgaaatgtgaccaaatgcagtgaaggacaaagtctatgactttagactgttgctagacctgcattactaaattcacggggtagtcatgatctcagattcaggatctcagagagaaaaggctagaagtgattattaatctgcaactactattatgattccattctcttactgattagggccacccactacacagcagcttgccagctggttggaagactcacctatctccatttctatgaaagctgcttcatctggtagcgcccgaggaatcactccagggtcactgaagctggtcctcaacagtgtagccatggagaaaaggaagagcatggcagcaaatacagggatggcaggagacagctgaacagccaggtagcggcacctgaagaaagcaggcaattcagcatttaatgatacctaccctatattgatctccaattgttaccagtatgtcaatctggcccccacaacagaatcagcagcacctcaagggcagggaccatgtttcttctcttgaattaccccaaacccctaacatatggctttacccatagtaggagctcaacaaataattgactgctgccacctataacatacagaagacacgcttgaggacactctcttacccccaagtccaatctatcctatcaacccactgggagctacatttcctctacctcaggaaaggttcacacctgctaagaatagggaagcaactgaacctggatttctaagcaacacaggttgatctcactctgggaatgtccagggcttctcataaccactgatctggcattcaagctgagcttgatgaagagggagaaaagatgaggaccaaccagaaagcaggttcacagtgtcagacagagagtatctcagcatgcttcaagaccagtgaaaaccttcagggctgttgactgactctgcaacatccattcctctggtctcctcaattagctcagctaataagtgactaatgaccatcagcaagaaaataagaaaatcgtttatccttagtaccccttcccaacatcatgttcactcccctctttcctcataatgcatctggcaagctatttctcttcctctctgaatatcccaactctactcatctttcaggtgccagagacatcaatatcattgtcatcattgcaactataatttattgagggctctccataagacaggcactgcactaagctcttcatctacattatcccatccaattctcacactaaatctatgaaatagatcctactatacccatttgatagatgaagaatctgagacttagagaattcttacctcctccaaaaggcttatgctaagctgcactaatctctctcttctctactccctgtggtcctcacttccagagccttgcattatttcctagctatttctcagtatgttgatggcatctccctcaactggacttcctaagagcaaggacctagtcttattggactgggaatgctccggtttgaattctggctctaccagctcctagttgggtgacttagttaacttcagtctccttatcgataaaatgaggataataacagtgcttgatgaggtcattgtgtggatcaaacgcactagtataaataaagtgcttagaactgcacttgacacacagtaaatactaaacactaagtaaaatgttagctattaacattaacaccatgattctgtatctcccagagctttaatacaagtaagggaacaaagaagctatcaataaatacttgttgatctgaactgaatttcaaacaaaataaataggaatatgtaaggagagttatcgctgacctatttttatcctcctcctcctgaggcacatttctccttgaaaacagagttttcacttggaggcagactataagtggatgagcaaggagcagagagagagcagagaaagtaagctaagaaaaacgcttacctcatcagcatgggaagtaagcaagctactggccattcaaagcaaacgtttaactcctggttatatattctctgcagtttcggaacaacccccatgaggtcttcccctagctccctgccacacacacaacttcatggggggacacaagccaagttttatattagactaagcagtttttgatgaaggtgcacatatgtactgaacctgaaggatgattttcgtgacttttgtgtttgcttgcttgcttatttttaacaaaatccttcatcttaagttgcttttttaatgatttacttccttctcctaaaagccaagggttgggggaaaactggagaactgaaggatctggcagctgagttcagggtaattaaggttcttacatatcactagcttgtggattaccctattttccactactccttttcactggtacagattaaccaaaaagggaattcagaagcaaaaatcacctccacttatcaggaacccaaaggatgcaggaaaagcatgaggcttcatttcatgaacaagccaagtgaaattaccacactaacagcaaataggaatcttcctggccactgcccatcactaagatcattcttgaaaacaaagaagtaatgtctccaggacgcaaactgccctggatgtatagtctccaatcaaaagccttaaaaatcagatgtatctgattggccaccaaagagagcttaatttttttattaaagggaaaacatacagagtgagtagagcaacagcaaaaaattctaaattaatgctgccccgctgcacagaaggacccgagcttaactaagtccagttccaacacctgcttgtaggccagacaaaggacaacttagatttgaattacgctatgccatcaaggataaaggtctctgtaatctccacacagagcatcttctgcacctgctaaaacaatccactctgtatgtcaacaagtacacaacaggcctattgtattgttctcctccagagatgaggctattggcagccagtcgtctctagtgagtgggtgtggctgggaagccagatgtgggactagcaggcctttctactctgagtaaggggaaacttcgagcgccagccactaagactattgtgaactacaacccatagtgtttgtcttcaaaagttatgataaaaaatacccccaccgggggtattgggaagggaggattgggaagatgtttgtcaaaggacataaaatttcagtaaggaagaataagttcatgagatctattgcccaacatgcggactatggttaataacactatattgtataccagaaaattgctaggagagtagattttaagcgttctcaccattaaaaaaataagtatgtaaggtaatacatatgttaattagcttgatttaactattccaaatgtatagatgtatcaaaacatcatattgtatacatatatatctttgtatatatatctttatatatatatataaaatatttgtcaatttaaaaaatacttcaaaaatatcaccctagactaatcccataattgctataagctggaagtctgtctctgacaagaataagctacgtgaaagtttggtggtaattcccaatatagacctccaaagtcaggagtatcctcaaacatcactaatttgtcttagataaagattagatcagccaggcacagtcgctcacacctgtaatcccagcactttgggaggtcaaggcaggtggatcatctgaggtcaggagttcaagaccatcctggccaacatggcaaaaccccatctctactaaaaacacaaaaataaggccgggtgcagtggctcacgcctgtaatcccagcactttgggaggctgaggtgggtggatcacaaggtcaggagatcaagaccaccctggctaacacagtgaaaccccgtctctactaaaaatacaaaaaattagccaggcgtggtggtgggtgcctgtagtcccagctacttgggaggctgaggcaggagaatggtgtgaacccgggaggtggagcttgcagtgagcggagatcgtgccactgcactccagcctgggtgacagtgcaagactccgtctcaaaaataaataaataaataaataaataaatacataagccggacgtggtggcatgcacctgtaatcccagcttactcgggaagctgagacaggagaatcacttgaacccatgaggcggaggttgcagtgagctgagattgcaccactgcactccagcctggtgacagagcaagactccacctcaaaaaaaaaaaaaaaaaaaagactaggtcagatctgtcatccacgaatataagctaattgtttctgaaactccctatatcactccatggaataataatatccatatacttcttaaaacagaactctcctgtattcaaagtaccaagaggcctttctccttcctggggattagagttccttttctcccttgtgaattttataaatgcaaccatgtcccaactaagtcttcatttctgccacctgaagagacatcatcattttaaaccatcctctactgacttcttgactgtcctcaggctaccatagctggactagacaactggactcccacatgtcccctcaggcggcacggtggtactgaccagcagtaaccatcagtgccaggctgggctcatgtgtcgtgtcccatcccccatccctagcatgctagttcactggagggatgatgataatgacacagacttcaattcacatgaaaacactcagaagagattcatgagtagaatgggtaagaatctagacagagagctatgccttacggattggcagcttggattggtgttctgtacaatacactgcttctaagtctccctaacagctttcttgctatgttttttggtttgtttgttcttttatcaatgtaatcagtcagccaacaagtacttgttggactaacaaatgaagaacaagggaaataggagttaattttgttggggaaaacataactgaaatatgaaacagctaaagaataagatgaccgataatcaagtgttagaatggtgactcagcctctaagggctgtaagtggtcagggaagagctctgtaggggagctgctggctgcttgaaactgctccagtagcagctggtaagtatggctttaaggaagaaggcccaaggatcagagccccatgatactctttggtcacacatgggagaaataagcctttgctataatacctccctgatatggatggccatctgtcctcttactacctacctgctacttactgaatgtctgtatccctgcaaaattcatatgttgaaatcttaacatccaatgtgatggattttggaggtggggcctttggggggtgattaggtcacctaaggctccaccctcatgaatgggattagcatccttataaaagaaatcctggcaagctcccttgcccctttggcaagggagagaagacagccatctatgaaccagaaagcaggccttcatcagtcaccaaacctgcaggcatcttgatcttgtacttgccagcctccagaactatgagacacaaatttctgttgtttataagccacccagtcgatggtagtttcttacagcagccagaacagactaagacactacctctagaagacaataaacatgtagaaccacccattaagactgtttcaagattcttctgatgaccctcagagtctgctgagaggggaagtttcccttaacactaaaaacataatttacaatcagcctccagatttacttctatgtgaaggtcagagaaaaatgcacaaccctcttttgctccagtagcaataaagaaaattaaccaaacagggacactttcaattctgaagtgagaagccatcctctcatcaaaatctctatccaggtaaacccgctcagtagtttccaaatttcagttataataacaaagttcaaatttcagttacaatatacccctgctcgagaacttagaaccattcactgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagcacaataccagcaccagcatctctgaggagaaagatttaggagtctcttctttccctcaataacatctcaactgatgtcagcatgttggggaacatccctgttctctgggcttgcttttcccaaaacagaggatcactatatttaattaagactcatcctcaaaagatgggagaggcattcagtggagactgaaaatgtgaaactcattaccacaaaaggaaatagaggctgaaaatgtagagaaattctgaatgacagaaccataaagaattattaaaggagccaggcatggtggcttacacctgtaatcccagcactttgggaggccaaggctgttggatcacttgagctcaggagttcaagaccagcctgggcaagatggtgagatcctgtctctacaaaaaatacaaaacttagtcaggcatagtggctcactcctgtagtcccagatacttgggaggctgaggtgggaggactgtttaagcccaggaggcagaggatgcagtgagccaagatcacaccactgcactccagcctaggcaagagagggagaccctatctcaaaaaaaaaaaaaaaaagaggaaaaaaaagaattattaaaagaaagcaaactgccgccaggtgcagtagctcacgcctgtaatcccagcactttgggaggcagaggcgggcggatcacctgaagtcaggagttcgagaccagcctggccaacacggagaaactctgtctctactaaaaaatacaaaattagcaaggcgtggtggcgcatgcctgtaatcccagctactcaggaggctgaggcaggagaatcgcttgaacccgggaggcggaggttgcagtgagccgagattgtgccattgcactccagcctgggcaacaagaatgaaactccgtctcaaagaaaaaaaaagaaaaagaaaagaaaaagaaagcaaactgttcaggagatacaacccaaggaactcttgggaagaactctctctcaaggaacatacttcatcaggaagttaagtttagctaagtactgtaacagattgataccaaagaggcaactatgcctttctaaaactcatttggttagtcaagtcacagacagaatccgaagctagataaagccaagactgacctccatagagtcattccccagagaatgcactcttggttacagagcacaatatagtcactttttcctcttcccaatctcacataaggatgctcttcaggaacctggaccttgtcactgtgggcactaacattctggtatgtcaaagtttggctttggtctacatagtcttgtgtctcctcaaacctagtaagttcatattatcaggtctgctttttctatttcacctgtctgccagacacacctcctctttcttttttctattttatttatttatttatttatttagatggagttttgttcttgttttgttgcccaggctggagtgcaatggcacaatctcggctcactgcaacctccgcctcccaagttcaagtgattctcctgcctcagcctcccaagtagctgggaatacaggtgtgcaccaccaagcccagctgactttttgtacttttagtagagacagggtttcaccatgttggcccggctggtctcgaactcctgacctcaagtgatccacctgcctcagcatcccaaagtgctgggattacaggcatgagccactgcgcccagcccacactgcccctttcatcaggataagtcactaagtaacaatgtacagagcacacattgcttgatttttctccaagccatcctcatcttggcagcagggaccaggagtggccacagcagtgatgatcccttgttaactcacaaagctcctgataggcttccctgttcctgcaaggctaccagaaatgccatgctgcaataccatcagttctctgcaaagatgccttcattttctaggagcataagcttgggagacccaaagagcctagatgccactgggtaacacacacactagctcgcaagaatctggaatatgctggcctagtatttggtactatgtacactttactaaagcatgtgtgtttgaatatcttcaggattccatagccaaagggtaacaatgaacaatgagataaaatgtcgaaattagaagaaaaagccctgagtcagtatagagacgttggctggtcaactcatcttgataaaggaaactcacttctgtgggcctggtttcctcaccccacacaaggagggagatagtctccaaagccctttccagatctaccatcctatgattctgtgggtcaagattgttaaattttaagtacatctagaatgttttaattcagcaacacttattggccatctactctatgtaaggcatggtagagagcactgtgggggctacacagccattgaacatagtctctgaccttgaaagagactagctgcgggggacaacaacagtgagaagtgtaatcaccatatagctccaaactataagaaatgtcatgtgattatctgttgaatgagcggtgtgtacaattagcccaatgaatgcagaaattactggaaagttttcatgaagaaagactcaagaaagaatttgaaagaggggtagaatttggataggctagaaaagtattgtttgtattgattactattgattactaagcagtgttacaaagctgttttcagttcatccaattcaatgactcttctgccaatatatacatcaaaagctctaatggggaccaacctgacagaacctggtctgacagtgccttgataagatttccttcatatacagaggacacagtgagaccataagcactgattatagcagcaaactgcttctgcttcaggggtcaagagtctcatagtcattcttgccacaagagaagtctgaggaccttgatcccactagtggccaggtcagaaagctaaaagagaaagctggaagccaattccaggagacagtgcacttgttcctttctccaggatcacactttatcaggaagttgaatttgactgaataccacgatagcctttcagtagctggatgtctcctaggttgtcagtggcattctgctacagtgtcctaacacttcaggccaagctggtagctatgtgttcatcgcacaagctggatagagcttaagcagaaagaactgaaaattgttcatgtgctcaaagctgaaactagcaatacacactcacatttcttaaatacctcaccctaagaattaattagaaaatcctttttctttaagcattataccatttttcactctgcttttaaacttaaatacgtttaccatgaatacaattatatttaaatatagcaacctactggtaatctataatctccttttgtgtgtatttgagtcttccagacagacacagagttatacagaatttcaggttcttggagttgcaagaggcttagtgaatatttggccaaatttctactcggtgacagcggcccgagagagaccccccggcttcttcagaaacacctctaacaggccgggcgcagtggctcatgcctgtaatcccagcacttggggaggctgaggcaggtggataacttgaggtcaggagttcgagacaagcctggccaacatggtgaaaccctgtctctactgaaaatacaaaaattatttgtatttggcaggtgtctgtaatcccagctactcgggaggctgaggcaggagaagtgcttgaacccgggaggcagaggttgcaaaagcagagatcatgccactgcactccagcctgggtgatggggcaaggccctgtctcaaaaaataaataaaaaataaaaaataattaaaaaaaaaaagaaacactctaacaatacagagctaactggccccaggatggacaactttttttgttttatgtattcaatctactatgtgtccactgaaaattacaggtcactcatttgaaaagtcttctagaagatatgtaaaggcataatccaaaaataaaaggacatctgccagcactgctaacattatgcgtttttcattaaggggcacccacatgcctgaccagacttctcaagccatctggctggcccagagctgtgctgcaggcagctataaatcaactcacacttgttcctaagcacctgctgcaagcaggaccctgctactaaaatgcagctccagatgtgcctcaagatttggactatcttcccacaaggtaaaaatacagcagccagaggatgtggagtctctactcctagacaatgtaagaatgaaaatagatcaccatttgtctattcagacaccctcacctgcctgaaggcagggggctagatcaactgatttcctgaggcctcactaagttcttttttttttttttttttaagacagagtctcactctgtcatccaggctaagatctcagctcactgcaacctccgcctcccaggtgcaagggattctcctgcctcagccttccgagtagctgggactacaggcgcacaacagccacacggggctaatttttgtatttttagtagagacgggggttttaccatgttggccaggctggtctcgaactcctgacctcaagtgatctgcctgcctcggcctccccaagtgctgggattacaggcatgagccactgcgctaagtcctaatactaacaaagcagcccacattctgctccccaaaccctgcccccactatgtggtggacaggaaattatagatgccaaagaaaaaggccgaccagaaggagatttcattcctcagaggcatgctggtgtaccttgtacaacctgtcactggctaggcacaaggcagccaccacctaaagtgtctatgtgtctgtatatgacagacacacacacacatacacaagcacgcacatccacacatgtacaaagtattcatcaccagggtcctctcctctgtggtcacatttccacctcccccctccactcctctgctaacacatttacttccttctcccctcttcttcccactactccctcctccagccctatcttcaaaaatatttagtctttcacacagacagctggtactcaagtaagttttacaaataacctcacccttcaaaatgcaagaaataacctggggcggggggaagtcatcatggtagaaaactcaacctgcctctgtcaaatggtaacttggctaattagaagcttcatcccaccagcggttttcttcagaggcctgcaggggcctcagtggaacagattccagtcagattcttctgctggctcccagatacaaaaggggacaaatggcaatacctccaaatttcaagtacccctggccagtcaaaccagaggtttcctgggcccagaactaccaactaactcaaagcctgggaacaaggctcatctctgtttggaatagttgtaataaaaatttaacctggaggtgggggtggggacaaaaagagaaaaagagaggaagaatgataaagaacagatgtcagctttgcacttccaagaagaagcaggacaggaatgaggcaaggaatacttggagagaagggtgaggagaaggaaaaacaatttttaatgctaggggcttatgcctgcctgactacacatgctcactggtaccacacacaagcacgtgcgtgcacatatgcacacacacacactcattcaggaaactcaaactggaaagcaaataagaagccttcagcaacctgcctgacttcactaaacacttcacaaagtcagcagtagcggcggcagcagcaaaaggacctttaacaaagagttcctctgaccttactttcccagccccgttataaactggatctccctccccctgctgttactcaagccagctgcaaccacccaaaagtctggcaaagcagcccaaaaatcactctgggtgcactgggaaagcctgaagccctcacagaaggacaaaaatgagccccaagggaccagagctcattttacttccccactaggctggccaaggtgccccctcctacctcccatggacacaccccagcataagccctccatttccaggtcacccatgtacatacaccatagcacgctcacctcaggtgtggcttacagtccacacacacacctcttggctctcaaaggcctcctcacagtaatcccaaaacaattagcaatgctcccatccctagagtgtagagcattctcagcacacccaggagacacgccacagtgccctagaatccagccggccacctcccctagagacgagacctacacagacttcaaacagtggctcgagtacgaggtattacaccacagaaaaaaaatcactccaaggctggtaccagacatacacagaatatagagctgtttacgttgagtgattttgagggaaagagcaactcacttctaataagcacgtatgtgccacgcacacaactagtatgtggtccagctgaggctggaactaatctgtaggttcccaactcagttggcttttcactgtaccagctagctgagagctgagccttaaggaaacaggacccagaataacaaaataggtgaggattgctgagtaatgtaacaatgaggggtgccctcaggtttgtgtgcaggggaggccatctgtcatttagcttctaaggagaccactaaaagggagaggtgagtaattaagacaaactttcttatttcccaagtctatcaaggacagccccaaatcagtactacaaaattggtatcaaaggtattggtctttttaggaagtacatactctgtgatgaccacgaagcaatgaattcagctggcatctctacagacatcgctcaagaggacgttaaagtcatccaaggaccagccccaaactccccagaaagcaggttcttcccctggacccaaagtaaccataatcaggtaactctactcaaccgaaactcactcaaaggcgaagaagagtgtacatgtccccaggatgaggaaaagggtcaggtagaaaatgcccttttgccgggccatcatgacgcggccatcacagcaaaaggtgttcctgcctgggagtttctcccatttccgtgtcaccttctttctcaccaccatcacagacatgattggaattcctgctccaaaatgggttttgcgattacacgagagaagaaacagaggctgagcccagctttgaaatcacgttgcctgctattcctgccgctgggtcaaacatcatcaaaagtccaattgctagccctaagaaaaagcagaaaaagaaaaaaaaatgaggcaataataagaaaatacagttcaaccctcctttcccagagacagaaagttgaaaactgactgaaggggtggggacggggaagtgggaaaagtttatttccaattcgtgtttgttctctaaaagaaggtatgataaaaggttctcaaaaaaggaaaggggctagtatttcttcttaaataagcctctatgcttccaatctaatgctgatgatctgatcatcacagaaccttggaactagagaggattttataggtgatcgtgccaattattaatactttgttttgtaaatgagtaaactgaggaccagagagaggaaataacttatccaggaccacacagcagcaatgctgatactgctaacttccagtcaagggcatgttccactatgccacagtgttctttcaacatcattaaaaggactctaaaaataatagtagagtttctgtccttataaaacctccctcccttcctccacttcaccttctttcttcaattagccactcgaatatgaatcacagcagggaacaagtcaccctctggcagggccaggaggttctggacgctctgtgcacatacgtgcattgtatttacacaaaacagatttcccctcatcaaaccctctgcaacttcctgagtccgggaaatgaaacaatctggctggtctagcctaacatttgtgagaatcttaatgaaaccacatcagagacctgtaggtgaaaggctgacttaagcaggagagattctggaatggttggtgactgctgatggctggttggggggtggggaatggcagcagctaagaaaagtcacaagggcgctttctgggacatgtcctaagtaccatctctactcagcatcctgaattcccaggcccagagtttctcagcctctgctacccttctcctccgctcaggtgtggtgttgtggcctctatttaccgacaccacatgccccacgctggcaggactgaggcggaagcctgcagcccgacggacggagggagaaacagccaactcgcgggctggagagggcaaaggtccaaaaacagcctaggagcggagcagggaaacgagaaggtagaaggttcggggaaggggaggggggcccagaggtgcagagaacccgtcctttgtgtaaaactaacctggaagacaatctcctcccgataaaccggcccagcgggagaagggagaccaggaagggggagccggcctggaagaacaaagatcaaaatccgtcgggaagcagcgaccggctccccagcggggggccggaggccggaggccggagtccggggccgagccgcgggcgcggcctctcgaggcccgccctgactccgccacgccgcggaccaccgccccaggcaggttgggacgcgcgccacatccacacgcacacgcagccacacgctcgtacacactcacacacgccccgccacgtgtagtcaccccgggccaggggctcggcggctgccgagttgagaagggcggtgccgacgtccccgcctccaggcgccgcggaaggggaggcagcccaccctgcagccgagcccaggagacccccgcccccacccctcgttacctgaaccacggagacccaactcggccggcagctgacggcaggaaacggaccgtcccagggaatcacgtcggcagccaaaggtggcagcgacttgtcctccccgggccgggaggctgtctcctcctgacaaggggccccagtggtcggggccctaaaccagctgtggcaaccgcccaccactggccaaatggaacgctcctcacgtcaccaggtcgctccagtagttgctcgccctctat

SEQ ID NO: 1370 - DNA, 40299 bp, Homo sapiens
gcacaaagaaacagacagccctgtatttctaaaaccattcaaggctccttcattaattggcttccccccaaaagaaagatttctttattaagaaataccagagagtgaaaaacccccaacacatacacatttgtaggctcacacaaaagtgcagagatttacatattaaattgcatttaaattagaaaatagatttaaaaacaaaatactttttttctccaacaaagtaaagagatttggtcagtaggaacgggtgctttatgggtaaaggcaggatggtcaggacagggagaatggaatttagctgctacggaatcagaatccacctctaacccaacctcactcctggggtaaaagcaaaggaggagatgatgatctcagctagggccaggaaggcctcagagctgaatggacatgaagaaatggctcaccacagccaatttccacctgcccccagaggtttgggatcagtgccaaccatcctggcctgggaaagtagggtgcataggaagcttgaggaagaaggaggaaggggagagttggagacagtgtcagccattgaaaagaccaaacaatttaaggcccttttcccctgggaacattgattctttaatctcccctctgatcagatagggacagtcccagctggtgcatggtatgaatgggacagatcttcaggccaacatcttaaacatggaagatttattaaggaaaagaaagagggcagggagtatgaaaaagcagaaaatcatttcacactagagataagagatttccactttgacccttcccatcagaaagagaaagcttctctgtctgacctaagggtcctcaggagaacacttgaggtaaggtgagggaggagagagagccatctgagcccaggagaggagatgggctgagtacttattaaaatggggttcatatgagtgccaagttacctggggaaacctaacaacttacaaattctccaggtttggctttataacttcaagaaaaaaaactgagagaaccagaaaaagaagcagacaggagagggatctgagtcagtctctccccatctctcttccaatctctctctctctctctctctcaagaatgctcaacttaaatcctgttaaaaggaaaaaggaagacatggaaaaaggtctgggagcagccaaatttcattaattccaattaactgggaagtatgagatgggaattgatagggagtcttgattatacaccacctagaaagaaatatataccatcacttgtaaaagaccactgatcaaatatttccaagggggggccctgatgagcctgcgttaataactaagacttattagcaattaacggcatccatctgcttcaaaacaatatcctaatatagagcttgttctcttaagtaaatataatccctctaccttcctgatcctgttcacactatatctccttgaaagtcctttcttcatagtccagaataagaaaaccttcagcccagaatgtagtatagatcaatggagagtttggaactacctctccaacccaagggtgccctggttaatggaagtttggggagtaacaagcaaccccttccaacccccacccccaccctacacacaaacatattcttgaaatggaagggggaaggaggaggcaggaagtttgcattagacacagtttaatcgccttcaaatagatgaaaagttctggtttacactcccccaccgcataagtcatccagacaggaccctggcttagaaagaggaaaacacaggtgctctaggaaatatagccacatataatacataaatcttcttccctgaaatagagcaggtcctgagcagagctgactgggggccacagcccacccccagggtgaagtggctctgggactctgccggtggaagtgctggaagagcggggcttggaggaagcccccagtgtggttaccatagccagaggtgggccgaggccttagggtgagttacccgagagggcagcagtgctgggctttccctcactcagccgaggcttaatggaagaactggttagcatttttttttttttgagggtacatcgggggagaggagaggagaggagagcctctctgtgccttggtttcccatttgtgcattcagggcctctgcaggcctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgccgctggcatctcataaattcttattgagaatggcacaggtattaaaaaagtttctgggtagtctacgagaaatgtcaattattatctctactacaactacttacatatatctaatgggaaaagagtggggcttaggtgtcagagtggatgggagacaaaggagaagctacactaataaatacaacaagtggaaggtacctgtcccattcctaaaaggatttgtgggcaatgctggcacttggtggccaggagaatcttctgaccccactctccctcctcttcagtcctgaagaccccaagaacccagttaggatcccctggccagaggtctctgtgactgcctctggactcagcacgtgcagcagcttgggaggatttgagccagtctcaaaaacttttagccccagaatgagaccagtgaccccaagcaggagggctgggatctggagggaagagagggggtccaaggggaccctgtggctgaggccatggagaaccagtgccagggcccaagagacccatttttccagttatcagaggtgactgacatcttctgccactgccttgagttcagaaatttaaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcagctgcctcctgtggtggctctgggggctctggaggtggcatctcttcgggagtgctgctgtcctccggcatctcatttgagttcaggtgttctgtgggggcctgagaaggaaaagatatgagattcaacacaaagctgttcctcaaaatccaaatgcagataaaccttagacactgaactcttcctctcagccccctgatcacactgatgctacagatatgcagccaccaacaccaaactcagaaccaacaccaagctatcgtcttctcggcagaacacaactgaagtttatttgagtttgatccttaactgttggttggggacagatttttctattattattaatagtcataataataggaatcacaaataattacacaggtcctccccacttcagaacaaatgtcataacatacttatgtaacaaggcctgacccaatggtcctcaatcgtgtttctgcccgaacacacagctcattagaatagtgattctgaaccaaagaaggccaagtgtccaaattttcagctggtcatatgtggtttgaaaatgtccccaagtgattctaaaataccacccttctccactttgaaccaagaataactaacctagattgttacaatttgagtccagactcatttaaaaaataatattaaaaatgacaacaataatatataaacacgggttgctgtactttaaaaggaaattcaaaatttaggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcatgataactagccaattatattgttatgaactgtttatatttctcctggaatatcagtgctttttaaaaaaattgatttgtatgagttccttatagttaagagtattaataaggaaaggaaatactacctcacatcagacctttttattttacttaagttctggggtacatgtgcaggatgtgcaggtttgttacataggtaaatgtgtgccatggtggtttgctgcacctataaagccatcacctaggtattaagcccagcatgcattagctatttttcctaatgctctccctcccttccccacccctcaacaggccccggtgtgtgttgttcccctccctgtgtccatgtgttctcattgttctcgaaagaagacattcatgcagccaacaaatatatgaaaaaatgctcaacatcactgatcattagagaaatgcaaatcaaaaaccacactgagataccatctcatgccagtcagaatggcgattattaaaaagtcaaaaaacaacagatgctggcaaggttgcggggaaataggaacgctattgttgttgggaatgtaaattagttcaaccattgtggaagatgtggcaattcctcaaagatctagaaccagaaataccatttgacccagcaatcccattactgggtatagaccttcttcttttttttttttttgagatggagtcttgctctgtcacccaggctggagtgcagtggcgcgatcttggctcactacaacctccgcctcccgggttcacgccattctcctgccttagcctcccgagtagctgggactacaggcgcccaccaccacgtcccctaattttttgtatttttagtagagatggggtttcaccatgttagccagaatggtcttgatctcctgacctcgtgatcctcccgctttggcctcccaaagtgctgggattacaggtgtgagccaccgcgcctggccagaccttctttaaatatcaagtttcctgcttcacttaaaatgggtttcgacagccgggtgtggtggctcatgcctgtaatctcagcactttgggaggcctaggtgggtggatcacaaggtcaggagttccagaccagcctgaccaacatggtgaaactccatctctactaaaaatacaaaaattagccgggcgtggtggtgtgcacctgtaataccagctactcaggaggctgaggcaggagaatcgcttgaacccaggaggtggaggttgcagtgagccgagatcatgccactgcactccagcctgggtgacacagtgagactccatctcaaaaaataaataaataaaatgggctttgacaatagatgctgatgaggctgtggagaaataggaacacttttacactgttggtgggagtgtaaattagttcaaccattgtggaagacagtgtggcgattcctcaaggatccagtaccagaaataccatttgacccagcaatcccattactgggtatatacccaaagcattataaatcattctaccataaagacacatgcacacatatgtttattgcagcactatttacaataccaaagacttggaaccaacccaaatgctcaccaatgatagaccggataaagaaaatgtggcacatatacaccatggaatactatgcacccataaaaaaggatgagttcatgtcctttgtagggacatggatgaagctggaagccatcattctcagcaaactaacacaggaacagaaaaccaaacaccgcatgttctcactcataagtgggagttgaacaatgagaacacatggacacagggaggggaacaacacatactggggtctgtcggggggtggggtgaggagggagggcattaggacaaatacctaatgcatgcagggcttaaaacgtagatgacaggttgataggtgcagcaaaccaccatggcacatgtatacctatgtaacaaacctgcacattctgcacacgtatcccagaacttaaagtaaaataaaaaataataataataataaaatgggttttgatttataaaaatcttatatacatatagtagctttttagtatacacgctgccgaagagagcaccatatagcttttaccatataaagcaatatatatctcccaacctttgcctaaagaaatggctagtaagaggaaagcaatgccctcaggatgccacatggtatacagaaaaaacattatccaatcatgggaactcaagaaaaagtaattttaaaaagaacattagaagtatgcctagtgatgatataagcaatttcacatataggcctatcaacaggaatctttatggcccatttctcatcttggccagggtttagcacacagtaggcagtgattacaacaaagccacatatatgtggatggaagtacagaccactgtattagacacacatatacctgaccctcttgcagcagcagcaaagagaagaaataagcagtttggaatcagacctgctctagcttaatctcatactaattatgtgaacttacatactggtgcttcacctatttcctcatccgtaaaatggggataataccaatctcatggggctgttacaagtcttaaatgagagaaaggtaaatcacttagcacagtgcccaatatgtagtagaaactcaataaatgctagcaactttcctcttcttgggttgcgtcttagacagaccttccttcctcaatgctgccctccagtggactaggtgtctcctcccactatgtaaggtgggtcccacatgaaaatccagtacaggaaaatctaaatttcaaaaataggtaaagtttatttttctcatttactaaagaggtttttgtaaagtttaggctagaggatatttaaattttgatttgatctacacaagtacagctgatttgcagtttttcaggagcttgttgcctatctaaatttccctatctaaatctagttcatttctcatctaaatctatcttccctcctcccaaaattggtgaccaccctgactttctagttcaactcagccttttccctaggcaatgtccctgtagttttactcacccacacagttgtcacagatgctgcaatgggaggcccggggaggccggaagatcttgcatgtgtaacagtatttcagtttcacaatctggttgtttatctggaaattcttgatacgaggcggtggtcgctggccctggggcaccgcaccattggtagcttctgtaaatcaataaagacagttaatatcacagctagccatcacttgagcccaaaagtctcaccacctctccaaaaccaatgggggcattcaaaggttccccaagccccctgtcttttatagactagacactcaacatcacagaatatgcccataaaactccactaagtgcatgcagttctgttgtatacataagaaaaagtgtttcttcgaggcttttttttctgattacaaagaaaaacattcatttaaaaaaatagctaaaaatacattaaatgaaaacatccaatttcactaataatcagagaaataaaaattaaagcacaaagataccatttttacctatcatattaaaaaacattacaaacaataaaaataccccatgttagcaagggtggggaaaggtcattcttagatcttatcagtgagcaatatggcagctgctactaaactttttttttcttttaagatgaagtctcgctctgtcgcccaggctggagtgcagtggtgggatctcagtcttggctcactgcaatttctgcctcctgggttcaagtgattctcctgtctcagcctcctgagtagctgggattacaggggcccaccaccatgcctggctgatttttgtatttttaatagagatggggttttatcatgtttgtcaggctggtctcagactccagacctcaagtgatccgcccgcctcagcctcccaaagtgctgggattacaggtgtgagccaccgtgcccagccagctaccaaagttttaaacgtgtatattcatttactgatcaagtctacttctagaaacttatcaaaattataatgagatatacgaaagatgtttatataaggatatttgtcacagagttccttttaatagtgaaaaactaaaaataacttcaatgtcacaatagaagggtggttaagtaaattatgttatgtgcatagaatggaatattatgcagccgttaaaaatgacatagacgaaagaatggtgaaaacaggaaaatacaatatatggcaaaatgaaaatgtatgttaaaaagcaatacgcataaaacaatactatcttgcaaacaaaatatatgcatgtgaaaagaaaagactggtaacacagaaacagttactgaaataaaagtaatgcttgcttattgtaaaaattttggaaaaaaacagaatagggccaggcatggtggctcacgcctgtaatcccagcactttgggaggctgaggcaggcggggcacctgagatcaggagtttgagaccagtctggccaacatggcaaaaccccgtgtctactaaaaatacaaaaattagccaagcatggtggcacgcatctgtaatcccagctactctggaggctgaggcaggagaatcgcttgaacctgggaggcagcctgggtgacagagcgagcaagactccaactcaaaaaaaaaattttttttggaaaaaaacaaagtataaataagaaaacataaaaatcactgacagtcagtctctcagctcagagatatttatattttttggcgtatttccttctaatcttctattaacaggtaaacattcataatttttaaaaaattgagatcatattataaatgcagatttgtaccatgaagtatttacttaatattatatgctgtgaacattttctcattgttaattttttttctaaaacataactactggcaatattccatcatatacgtgtactatgatttatttaaatattccatattgttgggattttttactatttaggtgatgtttcatgtaaaaatttaaaacattacagagaaaagcttaaatctccttcgatcaccacctcaatcctagtcccctcctcccttccaagaacatactcatgtgttaaaattaatttctaaaacagaaagaataaagaaaagaatggtgaagtataagcagtaatacatgaagttgccggcattaaaatagctactcatatttaaaagaaaagaaaaaatgatgcaccaaaaatccttctacagtaatttgtaaaaatctgtttatctcctttagctaaaccctcagagaagtagaactactgggtcaaagggtatgaccctttaaagtccatattacttgttgccaaactgcttcccagacagaccgtatgaatttgcatgcctgcccatccgcagcatatgagagtgcctgtctcattgcactctcaccatgcagtataattctaaaaacagaatatttttcaattcactttgattttaaaaatatctgccatatggaacatttttcctttttttgtggagtggggtagatgctgtgaaatcaaacaataacaatgtgtcacaagtcttaaaaggatgaggacagctattcattagaggataagtaccagcatgccaccttaatattctatgcatatgctttccatgagggcacctgggagacagggttcatggttcacctttctcaggaggccgtatcaggcaagggcatcacatgacttcctctctccccatcccccacccacagcatacccagtacaggactgaatataagatgacaaaaacttgctaacataaacatacatatgaactgaaaaatgtactcttctagtgagagaaacatgctaaatgcagaggccacaatgtgactgcttgagtctgagccccaggcccagtgatcaggcagaaaagagctaactttgttaacaacctgctgtgagaggcaggagacaagtcaaggtactgccttgaccctcagtttctccatatgtgaatgggaagggaactggaaaagaataatccagatggagaaaaaacagcactcacaactcttcctcaccatcttgctcctaactactcctagttctatcgggtctccccagaactccagctgtgccagcacacgtcgcctctgctctcttcccactatccccaccctcaccccacccccaaatagttatagctcacatgtgcacaaacccatttctccttagctcaactaaaacaggctggaatttttcaaaatgaaatccattaagaagcctaagggaaaacacagctaaaataaacaaaagaaatacatgggccgggcgcagtggcttacgcctgtaatcccagaactttggaaggccaaggtgagaggataacttgaggtcgggagttcaagactagcctggccaatatggtgaaacaccgtctctactaaaaatacaaaaattagctgggagtggtggcgggtgcccataatcccagctactctggaggctgaggcacgagaatcacttgaacctgggaggtgggggttgcagtgagctgagatcacgccactgcactccagcgtgggggacagagtgaaactgtgaaaaataaaaaagaagaaaggaaggaaaaataaaaaagaagaaaggaaggaaaggaaggaaaaaggaaggaaggaaggaagggagggagggagggagggaaggagggagggagggagggaaagaaaaagaaaaaagaaatacatggaagccttcaaagcaccgtcaaagaactaaaggctagccacagattggtgctctactggcacagcttcttagtcttacaagtcctgggtccctttttcttactctgtctagcttggatgctgactcaagctacctgggtaccaaacctgagaaccatttaggtaggcactgctgttgatctggtgggctcccactccctcctagtacttgcatcatagtcttctttctcactgtgagatcccaggatatctcctcctctggccctgggatggttctgcttcaaatcatgaagccaccctggctcctagataatgtagcacttcatctctgtaccaaagatccttatcctgagctgcagtatgcactctactgagcctgcaattgcttcttttacccctcctagaattctcagtggttcctggcaccacagctgccccctttcacattgcatgttcccctaaagcagcgttttttgtttgtttgttttggtttggttttttgagatggactctcgctctgttgcccaggctggagtgcagtggcgcaatctaggctcactgcaacctccgcctcccaggttcaagcgattctcgtgcctcagcctcccgagtagctgggattacaggcacatgccaccatgcccggctaatttttgtattttaagtagagacagggcttcaccatgttggccaggctagtcttgaactcctgacctcaagtgatctgcccgcctcagcctccccaagtgctgggattacaggcgtgagccacagcgcccggcctaaagcaggaattcttggttgggggggacatgaatgaacttcagaagatctatgaatccctgaaattacatacaaaattgtgtacatgtacatgcatataagagcatttttatggggagaaggtttacagctttcatcaaaaaaccaaaaagtggctcttgagccacttgctcaagccccctcccactctgtggagtgtacttttgtttcaataaatttgtgctggccaggtgtggtggctcacgcctgtaatcccagcaatttgggagatcaaggcgggcggatcacaaggtcaggagatcgagaccatcctggccaacacagtgaaatccccgtctctactaaaaatacaaaaattagctgggtgtggtggcatgtgactgtaatcccagctactcgggaggctgaggcaggagaatcacttaaacctgggagtcagaggttgcagtgagccaagatcacgccactgcacttcagcctggtaacagagccaggctctgtctctaaataaataaataaataaataataaatctgtgctttcattgcttcagaaaaaaatgtgttggtgaccacctcccccaaaaaagtaaaaaaccatcctcctgggaacaatacagcaggaccttggtaacaaatccttcctgaaatgtgaccaaatgcagtgaaggacaaagtctatgactttagactgttgctagacctgcattactaaattcacggggtagtcatgatctcagattcaggatctcagagagaaaaggctagaagtgattattaatctgcaactactattatgattccattctcttactgattagggccacccactacacagcagcttgccagctggttggaagactcacctatctccatttctatgaaagctgcttcatctggtagcgcccgaggaatcactccagggtcactgaagctggtcctcaacagtgtagccatggagaaaaggaagagcatggcagcaaatacagggatggcaggagacagctgaacagccaggtagcggcacctgaagaaagcaggcaattcagcatttaatgatacctaccctatattgatctccaattgttaccagtatgtcaatctggcccccacaacagaatcagcagcacctcaagggcagggaccatgtttcttctcttgaattaccccaaacccctaacatatggctttacccatagtaggagctcaacaaataattgactgctgccacctataacatacagaagacacgcttgaggacactctcttacccccaagtccaatctatcctatcaacccactgggagctacatttcctctacctcaggaaaggttcacacctgctaagaatagggaagcaactgaacctggatttctaagcaacacaggttgatctcactctgggaatgtccagggcttctcataaccactgatctggcattcaagctgagcttgatgaagagggagaaaagatgaggaccaaccagaaagcaggttcacagtgtcagacagagagtatctcagcatgcttcaagaccagtgaaaaccttcagggctgttgactgactctgcaacatccattcctctggtctcctcaattagctcagctaataagtgactaatgaccatcagcaagaaaataagaaaatcgtttatccttagtaccccttcccaacatcatgttcactcccctctttcctcataatgcatctggcaagctatttctcttcctctctgaatatcccaactctactcatctttcaggtgccagagacatcaatatcattgtcatcattgcaactataatttattgagggctctccataagacaggcactgcactaagctcttcatctacattatcccatccaattctcacactaaatctatgaaatagatcctactatacccatttgatagatgaagaatctgagacttagagaattcttacctcctccaaaaggcttatgctaagctgcactaatctctctcttctctactccctgtggtcctcacttccagagccttgcattatttcctagctatttctcagtatgttgatggcatctccctcaactggacttcctaagagcaaggacctagtcttattggactgggaatgctccggtttgaattctggctctaccagctcctagttgggtgacttagttaacttcagtctccttatcgataaaatgaggataataacagtgcttgatgaggtcattgtgtggatcaaacgcactagtataaataaagtgcttagaactgcacttgacacacagtaaatactaaacactaagtaaaatgttagctattaacattaacaccatgattctgtatctcccagagctttaatacaagtaagggaacaaagaagctatcaataaatacttgttgatctgaactgaatttcaaacaaaataaataggaatatgtaaggagagttatcgctgacctatttttatcctcctcctcctgaggcacatttctccttgaaaacagagttttcacttggaggcagactataagtggatgagcaaggagcagagagagagcagagaaagtaagctaagaaaaacgcttacctcatcagcatgggaagtaagcaagctactggccattcaaagcaaacgtttaactcctggttatatattctctgcagtttcggaacaacccccatgaggtcttcccctagctccctgccacacacacaacttcatggggggacacaagccaagttttatattagactaagcagtttttgatgaaggtgcacatatgtactgaacctgaaggatgattttcgtgacttttgtgtttgcttgcttgcttatttttaacaaaatccttcatcttaagttgcttttttaatgatttacttccttctcctaaaagccaagggttgggggaaaactggagaactgaaggatctggcagctgagttcagggtaattaaggttcttacatatcactagcttgtggattaccctattttccactactccttttcactggtacagattaaccaaaaagggaattcagaagcaaaaatcacctccacttatcaggaacccaaaggatgcaggaaaagcatgaggcttcatttcatgaacaagccaagtgaaattaccacactaacagcaaataggaatcttcctggccactgcccatcactaagatcattcttgaaaacaaagaagtaatgtctccaggacgcaaactgccctggatgtatagtctccaatcaaaagccttaaaaatcagatgtatctgattggccaccaaagagagcttaatttttttattaaagggaaaacatacagagtgagtagagcaacagcaaaaaattctaaattaatgctgccccgctgcacagaaggacccgagcttaactaagtccagttccaacacctgcttgtaggccagacaaaggacaacttagatttgaattacgctatgccatcaaggataaaggtctctgtaatctccacacagagcatcttctgcacctgctaaaacaatccactctgtatgtcaacaagtacacaacaggcctattgtattgttctcctccagagatgaggctattggcagccagtcgtctctagtgagtgggtgtggctgggaagccagatgtgggactagcaggcctttctactctgagtaaggggaaacttcgagcgccagccactaagactattgtgaactacaacccatagtgtttgtcttcaaaagttatgataaaaaatacccccaccgggggtattgggaagggaggattgggaagatgtttgtcaaaggacataaaatttcagtaaggaagaataagttcatgagatctattgcccaacatgcggactatggttaataacactatattgtataccagaaaattgctaggagagtagattttaagcgttctcaccattaaaaaaataagtatgtaaggtaatacatatgttaattagcttgatttaactattccaaatgtatagatgtatcaaaacatcatattgtatacatatatatctttgtatatatatctttatatatatatataaaatatttgtcaatttaaaaaatacttcaaaaatatcaccctagactaatcccataattgctataagctggaagtctgtctctgacaagaataagctacgtgaaagtttggtggtaattcccaatatagacctccaaagtcaggagtatcctcaaacatcactaatttgtcttagataaagattagatcagccaggcacagtcgctcacacctgtaatcccagcactttgggaggtcaaggcaggtggatcatctgaggtcaggagttcaagaccatcctggccaacatggcaaaaccccatctctactaaaaacacaaaaataaggccgggtgcagtggctcacgcctgtaatcccagcactttgggaggctgaggtgggtggatcacaaggtcaggagatcaagaccaccctggctaacacagtgaaaccccgtctctactaaaaatacaaaaaattagccaggcgtggtggtgggtgcctgtagtcccagctacttgggaggctgaggcaggagaatggtgtgaacccgggaggtggagcttgcagtgagcggagatcgtgccactgcactccagcctgggtgacagtgcaagactccgtctcaaaaataaataaataaataaataaataaatacataagccggacgtggtggcatgcacctgtaatcccagcttactcgggaagctgagacaggagaatcacttgaacccatgaggcggaggttgcagtgagctgagattgcaccactgcactccagcctggtgacagagcaagactccacctcaaaaaaaaaaaaaaaaaaaagactaggtcagatctgtcatccacgaatataagctaattgtttctgaaactccctatatcactccatggaataataatatccatatacttcttaaaacagaactctcctgtattcaaagtaccaagaggcctttctccttcctggggattagagttccttttctcccttgtgaattttataaatgcaaccatgtcccaactaagtcttcatttctgccacctgaagagacatcatcattttaaaccatcctctactgacttcttgactgtcctcaggctaccatagctggactagacaactggactcccacatgtcccctcaggcggcacggtggtactgaccagcagtaaccatcagtgccaggctgggctcatgtgtcgtgtcccatcccccatccctagcatgctagttcactggagggatgatgataatgacacagacttcaattcacatgaaaacactcagaagagattcatgagtagaatgggtaagaatctagacagagagctatgccttacggattggcagcttggattggtgttctgtacaatacactgcttctaagtctccctaacagctttcttgctatgttttttggtttgtttgttcttttatcaatgtaatcagtcagccaacaagtacttgttggactaacaaatgaagaacaagggaaataggagttaattttgttggggaaaacataactgaaatatgaaacagctaaagaataagatgaccgataatcaagtgttagaatggtgactcagcctctaagggctgtaagtggtcagggaagagctctgtaggggagctgctggctgcttgaaactgctccagtagcagctggtaagtatggctttaaggaagaaggcccaaggatcagagccccatgatactctttggtcacacatgggagaaataagcctttgctataatacctccctgatatggatggccatctgtcctcttactacctacctgctacttactgaatgtctgtatccctgcaaaattcatatgttgaaatcttaacatccaatgtgatggattttggaggtggggcctttggggggtgattaggtcacctaaggctccaccctcatgaatgggattagcatccttataaaagaaatcctggcaagctcccttgcccctttggcaagggagagaagacagccatctatgaaccagaaagcaggccttcatcagtcaccaaacctgcaggcatcttgatcttgtacttgccagcctccagaactatgagacacaaatttctgttgtttataagccacccagtcgatggtagtttcttacagcagccagaacagactaagacactacctctagaagacaataaacatgtagaaccacccattaagactgtttcaagattcttctgatgaccctcagagtctgctgagaggggaagtttcccttaacactaaaaacataatttacaatcagcctccagatttacttctatgtgaaggtcagagaaaaatgcacaaccctcttttgctccagtagcaataaagaaaattaaccaaacagggacactttcaattctgaagtgagaagccatcctctcatcaaaatctctatccaggtaaacccgctcagtagtttccaaatttcagttataataacaaagttcaaatttcagttacaatatacccctgctcgagaacttagaaccattcactgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagcacaataccagcaccagcatctctgaggagaaagatttaggagtctcttctttccctcaataacatctcaactgatgtcagcatgttggggaacatccctgttctctgggcttgcttttcccaaaacagaggatcactatatttaattaagactcatcctcaaaagatgggagaggcattcagtggagactgaaaatgtgaaactcattaccacaaaaggaaatagaggctgaaaatgtagagaaattctgaatgacagaaccataaagaattattaaaggagccaggcatggtggcttacacctgtaatcccagcactttgggaggccaaggctgttggatcacttgagctcaggagttcaagaccagcctgggcaagatggtgagatcctgtctctacaaaaaatacaaaacttagtcaggcatagtggctcactcctgtagtcccagatacttgggaggctgaggtgggaggactgtttaagcccaggaggcagaggatgcagtgagccaagatcacaccactgcactccagcctaggcaagagagggagaccctatctcaaaaaaaaaaaaaaaaagaggaaaaaaaagaattattaaaagaaagcaaactgccgccaggtgcagtagctcacgcctgtaatcccagcactttgggaggcagaggcgggcggatcacctgaagtcaggagttcgagaccagcctggccaacacggagaaactctgtctctactaaaaaatacaaaattagcaaggcgtggtggcgcatgcctgtaatcccagctactcaggaggctgaggcaggagaatcgcttgaacccgggaggcggaggttgcagtgagccgagattgtgccattgcactccagcctgggcaacaagaatgaaactccgtctcaaagaaaaaaaaagaaaaagaaaagaaaaagaaagcaaactgttcaggagatacaacccaaggaactcttgggaagaactctctctcaaggaacatacttcatcaggaagttaagtttagctaagtactgtaacagattgataccaaagaggcaactatgcctttctaaaactcatttggttagtcaagtcacagacagaatccgaagctagataaagccaagactgacctccatagagtcattccccagagaatgcactcttggttacagagcacaatatagtcactttttcctcttcccaatctcacataaggatgctcttcaggaacctggaccttgtcactgtgggcactaacattctggtatgtcaaagtttggctttggtctacatagtcttgtgtctcctcaaacctagtaagttcatattatcaggtctgctttttctatttcacctgtctgccagacacacctcctctttcttttttctattttatttatttatttatttatttagatggagttttgttcttgttttgttgcccaggctggagtgcaatggcacaatctcggctcactgcaacctccgcctcccaagttcaagtgattctcctgcctcagcctcccaagtagctgggaatacaggtgtgcaccaccaagcccagctgactttttgtacttttagtagagacagggtttcaccatgttggcccggctggtctcgaactcctgacctcaagtgatccacctgcctcagcatcccaaagtgctgggattacaggcatgagccactgcgcccagcccacactgcccctttcatcaggataagtcactaagtaacaatgtacagagcacacattgcttgatttttctccaagccatcctcatcttggcagcagggaccaggagtggccacagcagtgatgatcccttgttaactcacaaagctcctgataggcttccctgttcctgcaaggctaccagaaatgccatgctgcaataccatcagttctctgcaaagatgccttcattttctaggagcataagcttgggagacccaaagagcctagatgccactgggtaacacacacactagctcgcaagaatctggaatatgctggcctagtatttggtactatgtacactttactaaagcatgtgtgtttgaatatcttcaggattccatagccaaagggtaacaatgaacaatgagataaaatgtcgaaattagaagaaaaagccctgagtcagtatagagacgttggctggtcaactcatcttgataaaggaaactcacttctgtgggcctggtttcctcaccccacacaaggagggagatagtctccaaagccctttccagatctaccatcctatgattctgtgggtcaagattgttaaattttaagtacatctagaatgttttaattcagcaacacttattggccatctactctatgtaaggcatggtagagagcactgtgggggctacacagccattgaacatagtctctgaccttgaaagagactagctgcgggggacaacaacagtgagaagtgtaatcaccatatagctccaaactataagaaatgtcatgtgattatctgttgaatgagcggtgtgtacaattagcccaatgaatgcagaaattactggaaagttttcatgaagaaagactcaagaaagaatttgaaagaggggtagaatttggataggctagaaaagtattgtttgtattgattactattgattactaagcagtgttacaaagctgttttcagttcatccaattcaatgactcttctgccaatatatacatcaaaagctctaatggggaccaacctgacagaacctggtctgacagtgccttgataagatttccttcatatacagaggacacagtgagaccataagcactgattatagcagcaaactgcttctgcttcaggggtcaagagtctcatagtcattcttgccacaagagaagtctgaggaccttgatcccactagtggccaggtcagaaagctaaaagagaaagctggaagccaattccaggagacagtgcacttgttcctttctccaggatcacactttatcaggaagttgaatttgactgaataccacgatagcctttcagtagctggatgtctcctaggttgtcagtggcattctgctacagtgtcctaacacttcaggccaagctggtagctatgtgttcatcgcacaagctggatagagcttaagcagaaagaactgaaaattgttcatgtgctcaaagctgaaactagcaatacacactcacatttcttaaatacctcaccctaagaattaattagaaaatcctttttctttaagcattataccatttttcactctgcttttaaacttaaatacgtttaccatgaatacaattatatttaaatatagcaacctactggtaatctataatctccttttgtgtgtatttgagtcttccagacagacacagagttatacagaatttcaggttcttggagttgcaagaggcttagtgaatatttggccaaatttctactcggtgacagcggcccgagagagaccccccggcttcttcagaaacacctctaacaggccgggcgcagtggctcatgcctgtaatcccagcacttggggaggctgaggcaggtggataacttgaggtcaggagttcgagacaagcctggccaacatggtgaaaccctgtctctactgaaaatacaaaaattatttgtatttggcaggtgtctgtaatcccagctactcgggaggctgaggcaggagaagtgcttgaacccgggaggcagaggttgcaaaagcagagatcatgccactgcactccagcctgggtgatggggcaaggccctgtctcaaaaaataaataaaaaataaaaaataattaaaaaaaaaaagaaacactctaacaatacagagctaactggccccaggatggacaactttttttgttttatgtattcaatctactatgtgtccactgaaaattacaggtcactcatttgaaaagtcttctagaagatatgtaaaggcataatccaaaaataaaaggacatctgccagcactgctaacattatgcgtttttcattaaggggcacccacatgcctgaccagacttctcaagccatctggctggcccagagctgtgctgcaggcagctataaatcaactcacacttgttcctaagcacctgctgcaagcaggaccctgctactaaaatgcagctccagatgtgcctcaagatttggactatcttcccacaaggtaaaaatacagcagccagaggatgtggagtctctactcctagacaatgtaagaatgaaaatagatcaccatttgtctattcagacaccctcacctgcctgaaggcagggggctagatcaactgatttcctgaggcctcactaagttcttttttttttttttttttaagacagagtctcactctgtcatccaggctaagatctcagctcactgcaacctccgcctcccaggtgcaagggattctcctgcctcagccttccgagtagctgggactacaggcgcacaacagccacacggggctaatttttgtatttttagtagagacgggggttttaccatgttggccaggctggtctcgaactcctgacctcaagtgatctgcctgcctcggcctccccaagtgctgggattacaggcatgagccactgcgctaagtcctaatactaacaaagcagcccacattctgctccccaaaccctgcccccactatgtggtggacaggaaattatagatgccaaagaaaaaggccgaccagaaggagatttcattcctcagaggcatgctggtgtaccttgtacaacctgtcactggctaggcacaaggcagccaccacctaaagtgtctatgtgtctgtatatgacagacacacacacacatacacaagcacgcacatccacacatgtacaaagtattcatcaccagggtcctctcctctgtggtcacatttccacctcccccctccactcctctgctaacacatttacttccttctcccctcttcttcccactactccctcctccagccctatcttcaaaaatatttagtctttcacacagacagctggtactcaagtaagttttacaaataacctcacccttcaaaatgcaagaaataacctggggcggggggaagtcatcatggtagaaaactcaacctgcctctgtcaaatggtaacttggctaattagaagcttcatcccaccagcggttttcttcagaggcctgcaggggcctcagtggaacagattccagtcagattcttctgctggctcccagatacaaaaggggacaaatggcaatacctccaaatttcaagtacccctggccagtcaaaccagaggtttcctgggcccagaactaccaactaactcaaagcctgggaacaaggctcatctctgtttggaatagttgtaataaaaatttaacctggaggtgggggtggggacaaaaagagaaaaagagaggaagaatgataaagaacagatgtcagctttgcacttccaagaagaagcaggacaggaatgaggcaaggaatacttggagagaagggtgaggagaaggaaaaacaatttttaatgctaggggcttatgcctgcctgactacacatgctcactggtaccacacacaagcacgtgcgtgcacatatgcacacacacacactcattcaggaaactcaaactggaaagcaaataagaagccttcagcaacctgcctgacttcactaaacacttcacaaagtcagcagtagcggcggcagcagcaaaaggacctttaacaaagagttcctctgaccttactttcccagccccgttataaactggatctccctccccctgctgttactcaagccagctgcaaccacccaaaagtctggcaaagcagcccaaaaatcactctgggtgcactgggaaagcctgaagccctcacagaaggacaaaaatgagccccaagggaccagagctcattttacttccccactaggctggccaaggtgccccctcctacctcccatggacacaccccagcataagccctccatttccaggtcacccatgtacatacaccatagcacgctcacctcaggtgtggcttacagtccacacacacacctcttggctctcaaaggcctcctcacagtaatcccaaaacaattagcaatgctcccatccctagagtgtagagcattctcagcacacccaggagacacgccacagtgccctagaatccagccggccacctcccctagagacgagacctacacagacttcaaacagtggctcgagtacgaggtattacaccacagaaaaaaaatcactccaaggctggtaccagacatacacagaatatagagctgtttacgttgagtgattttgagggaaagagcaactcacttctaataagcacgtatgtgccacgcacacaactagtatgtggtccagctgaggctggaactaatctgtaggttcccaactcagttggcttttcactgtaccagctagctgagagctgagccttaaggaaacaggacccagaataacaaaataggtgaggattgctgagtaatgtaacaatgaggggtgccctcaggtttgtgtgcaggggaggccatctgtcatttagcttctaaggagaccactaaaagggagaggtgagtaattaagacaaactttcttatttcccaagtctatcaaggacagccccaaatcagtactacaaaattggtatcaaaggtattggtctttttaggaagtacatactctgtgatgaccacgaagcaatgaattcagctggcatctctacagacatcgctcaagaggacgttaaagtcatccaaggaccagccccaaactccccagaaagcaggttcttcccctggacccaaagtaaccataatcaggtaactctactcaaccgaaactcactcaaaggcgaagaagagtgtacatgtccccaggatgaggaaaagggtcaggtagaaaatgcccttttgccgggccatcatgacgcggccatcacagcaaaaggtgttcctgcctgggagtttctcccatttccgtgtcaccttctttctcaccaccatcacagacatgattggaattcctgctccaaaatgggttttgcgattacacgagagaagaaacagaggctgagcccagctttgaaatcacgttgcctgctattcctgccgctgggtcaaacatcatcaaaagtccaattgctagccctaagaaaaagcagaaaaagaaaaaaaaatgaggcaataataagaaaatacagttcaaccctcctttcccagagacagaaagttgaaaactgactgaaggggtggggacggggaagtgggaaaagtttatttccaattcgtgtttgttctctaaaagaaggtatgataaaaggttctcaaaaaaggaaaggggctagtatttcttcttaaataagcctctatgcttccaatctaatgctgatgatctgatcatcacagaaccttggaactagagaggattttataggtgatcgtgccaattattaatactttgttttgtaaatgagtaaactgaggaccagagagaggaaataacttatccaggaccacacagcagcaatgctgatactgctaacttccagtcaagggcatgttccactatgccacagtgttctttcaacatcattaaaaggactctaaaaataatagtagagtttctgtccttataaaacctccctcccttcctccacttcaccttctttcttcaattagccactcgaatatgaatcacagcagggaacaagtcaccctctggcagggccaggaggttctggacgctctgtgcacatacgtgcattgtatttacacaaaacagatttcccctcatcaaaccctctgcaacttcctgagtccgggaaatgaaacaatctggctggtctagcctaacatttgtgagaatcttaatgaaaccacatcagagacctgtaggtgaaaggctgacttaagcaggagagattctggaatggttggtgactgctgatggctggttggggggtggggaatggcagcagctaagaaaagtcacaagggcgctttctgggacatgtcctaagtaccatctctactcagcatcctgaattcccaggcccagagtttctcagcctctgctacccttctcctccgctcaggtgtggtgttgtggcctctatttaccgacaccacatgccccacgctggcaggactgaggcggaagcctgcagcccgacggacggagggagaaacagccaactcgcgggctggagagggcaaaggtccaaaaacagcctaggagcggagcagggaaacgagaaggtagaaggttcggggaaggggaggggggcccagaggtgcagagaacccgtcctttgtgtaaaactaacctggaagacaatctcctcccgataaaccggcccagcgggagaagggagaccaggaagggggagccggcctggaagaacaaagatcaaaatccgtcgggaagcagcgaccggctccccagcggggggccggaggccggaggccggagtccggggccgagccgcgggcgcggcctctcgaggcccgccctgactccgccacgccgcggaccaccgccccaggcaggttgggacgcgcgccacatccacacgcacacgcagccacacgctcgtacacactcacacacgccccgccacgtgtagtcaccccgggccaggggctcggcggct

SEQ ID NO: 1371 - DNA, 587912 bp, Homo sapiens
tttcattggcaattttattttttaaaaatgaaatattcaaagtacttttctttcaaatatcaacacataatgtttaactttaaatatttacagcatgttgttgtgatgctcttgtagaaaaatgcatgcttctggcctgaaagccagagcaaaatgcaaaagaccatttaactgcagccagagaacatgaacctgtacagtatccagtcacttttcagcacaggagagcaggaatacaaaattggaacctattgtttcctagcaacatggctcagaccattataacacaattttcaatatgattagaacctctacctgttgttatacagaaactgaaaacttggcatacactgtaaacatctttacttttcatgagaaagtaagcagctaaaaagaatgtttttctgacataaaggctatacttctctttttcgccttctttcttactgatgcttttgccagaagaatagtaaagatttagacgttgtcatgattcatacaagtaaaatatttttcaaggacacaatctgatatactaacatttatttaagaggttaaagtccaccactaaatctaaggaaagatttttaactgccaaacacatttcctttgacaaataatgtaagatgacaactgccaagacaaaatccacagcaagtttaactctaagtattttcagttactgtttagaaagtaatttcttcttatgaacagtagtatatttggtccttaatagctttcacatgaaggacacactgaaaataatagtcactatttatggttgaattcttttttgttgtttgttttctgtatttttaaattttactttgcttttttttgtttttttgttttttgcgctttttttgttttttttgttttgttttgttttgttttgttttctttgcagaagaaagaacctttatagaaggctgtggaagagctgaagtactagtcaggtcagctatgtgtatgtgaatttcttcaagaaaacaggaatgttccattccatctgtagccttatgtctttccacaagctatatataatatgctccaatgtctccaaaattttcttttcaatacttcgttactgtacttttgcttctattaccaatgaactccattacaatcacccttacatgaacacatcttcataaatgcaaaaactttgccctgactctcttaagtgatattatagtggggcctggtctagttaaaaatatatttttaaagaaaaaaaaaagaaaaagagtcaaaataacatgatggaatgcttgaaactgtgtcaacagtgatgaaaatgtctcatgaaaattataacttaatttcatacctgtctacataggtagcatgtgaattccaaattatacattgtcaagttttcatacatttggctatgttgtatatattatatatatgtagtctatatattatagatcttctagataaattgacagtaaaggacacacttattttatacattttttgggttaaaaataaatcatatacttatttatatggtaaaagtgttttgttgcaagttagtatgaattgagatttatttccctttccttcaggagtcatgcttctaatcaataacgattagaatgacaactaaaagtaaacatatttaaatgtgttaaactttgaacttttcagttcatttggatctctagactgtagtgcaagagtgaaaacaaaacaaaacagaaaagcacaaacaaaatgggcttaagtaggaaaaagaaacaaccatggagtattccctgcctccagcccagaatgttcttcataggagagtccaactactatgctctcactttaacttactcgaatggtgtgtggctgtgcagtgtcagccatctgtctgctgggtatgagaaattcatatgtttctctgaaaaatgcttttactttcatcaggaaatgcaaacgaattgttctttcaataatttaaactgcagaactgcaagtcaatgaaggcattctttctattcagctgaataggaagtgatatactcaatatctccatcttcttcttaagaaatgccaaaatgtttctcttcgatttactactgattagtagttttgttttttttttctttcctccctcaagctttaggagttgtaaaaagaataataatagttcaaggcagtattaaaaccacagctgtaagtaataaaaagtgcatttcctgaatataatacaaatgtaactttaacaaactaaaggcacgaaccaaccaaatacgtattacaaactagaaatgcacagttcaaggtaatcactattaagtaaaagcttcaaatatttgtttctaatggatatttaaagcagtttgaaaatgatacatcatcaatgaattgcaaaaacgtataattgcttaaaatataagcaaaatagactctaatattgacattttggatttgtgataaaatacataatcacatttatgaatgcactctctatatacagttcacaaattatttttccattaatttaaaagaacatcagaggttctaggaacttaaggtccatttttaggttggtgtggaggtattcaaattttcaacaagtttgttagtaattttagaattccattctgaataaatactgtaccattaatacaggcctgattcagaaaaaacccaataatatgattttagtatggattagcaatatatcaagctggtgtgtttccagttataaagagagatgagttcctcatgaattctgtctctcagaatacatgtgtaagtggtattctaacccgaaggttttgaaaatgaaatgtttgaatacacccttccctactgtttgccagggtcatttcctttcccttgctttcctttgtgtagtaggaggcagactcttgaaaaaccttaacatgagcttatgactttgcatattttcaaagaaactgtcatcgcaaagcaaggcaatgaccccacactgcatttaggtagcatctggaaagaatccaaactaacattccatcataaatttgccttcagacatagcaaatgttcagattcggtgatgaaagtgcagaagctggctcaggggaattttctacgggccacattgtgctgtcatgtattttcatttgtggtaacttacaattacacagcattttacaaactatctctttgtcactgggcacaaatcttccagctcaccaaggggcttgttttactgcaggattcctagagattgagaaactgcagctgatattaacactaatcctgacctttctccaaattttaaatgatcgcagaacaaataacccgtcctggaaaatagttattttcctaggcagtagagacgattaaataaagataaatgggtaagtacggagaacgaaaataactaactgtataaattattttagtaaaaatgagtctgcctctctatagttagttgaaatgttttcggttggaaaggatttacttgattcgatttcctgaagatggctgggagatgttcaatacagaattgtacatttgaaagataaatctaagtgggctgaaacaatgtggcagcaactgctgtgatgtttggtctggtcttccctttagtactttcacttaagtaccaggtctatttttttaaggttttggctcttatgaatttctgcagtagtagttaatgtatgtatcggcatcccagacacgtatgcctgctaaagcctttgtttgtttttgtaccagaatcatacttttaagtaaattaccgttcatgtgcacaaaaccattgggtcagtgtatagatactgaatcactaatgtgaaactatgaccaaaacacatcctatatataaatgagaaattcctacccaggttaataaaagctatgtttacatgataccaatacagctgaacaacttttagtaaaaaattgagtcaaaacaggtcgtgtgagagaggtcacgctggccagctgctttggtatcatgtacacacgagcaaatagcggctatacagtctggttaccacacccacagggaagcatggtagacagaacccagccaccacacgccaaaacacagcacaacaatatggcatttactttaacaagcaaggaggaataatcaagaaggaagggcaattgggtcctcactctaggagatggtggctgaagacattttacacctgtttttaagtttcctataacagatctggaaaacgtcaaagggctggcagtctttcgaaaggcaagtttcagatactattgcaccacctattcaaatagcccgtaagttctgccaacagttaaggatgaaactgcttctcacaatagagatagagaaccttgggttctttctggatattggaacatatgcatggctcggcaaattgaaagtggtgctttctgaaaactgtttttagctgtttgagttctacttgtgttattttgaatactgccacacaagaactaaaaatctctgtcatttcttaaagagtttaaacaaacaatattaaaataccatcttccgtcacattgaaaggcagttggatatgtttttcctccatatttacatatacagagttctgatctagaaaaccaatacaataaaccattttatgttttaaaaacaggcagtctttggtgacgcaaaggcagagatatttttgttacctcctgcctatttcgctctgtctcataaagtgaatattattggcactgtcagaaagttctaaatactgctcaacagacaaaacaaaatacccatcgtaaccttgtacccgcccagtgctcaaaagctgctgcttttccccttctgtccatgccctaatcccctcttccccctcttgcagccttctttgttccttagtccaggcctgggccactgcgcgctgtctggcaatctccaacacgtgattcttttcctcttcgacagttgtcccataccggatgttgaagcacagggctccatgctggagctgaatatctgcaaaccgtctagtcctcccattcaacacagaagtcatctgggacacagtgacattgacaccattctccagaatccgcctccccccagtgttaccgatgagcaccaggtcttcctccagagacccaagcttaatgaagtagtgagtgtccctcccctctatggtaaaatgtaggttttccaggtaatgggcattattgagaatggcagcaagccgcctgctatcttcattggctactcctataatatcagctgttactatgccatccttgatggcaaattttatacctttcccaaaaacagaagggacagcagcaaaccttggttgcttccctccttcaaggcaccgtccatcattgtatcggggagtcataggtagttggtccaaggaaatgaaattcctgagctgtttctggagttcacactgaatgcccaggatagtctaggaaagagaggcacagagcagatgcagcatggagttagacatctgtcagatacttggtgattgtggaaaggacaggcttgcaagtttgcttccttctctctttaatttgtcagtgagtgatttaaaaataagccagatttggaatctcttcatcagagatttggaaaagactaacaggtgactacctagcattcttatatcttggtggagttaagcataaggaaatacatttaaacttgaaatcacagaattgcagagctggaaggcactttaagttggtccagctctcccaaaacacagacattttattttcactgatttcactcacactgactagatgttattactacatgtagagtaatacttaggcacagtgaggcacaaagaaatgcataaggcatagttcctactttaaagagtttaagaccttataattaactatggcaaatcagccagaaattcattgatctttttatgtggacttaaaaaaaacctttttttttgggcaattttcaaacatactaagaaataaagagaaaagactaatgaacctccaagtatccattatgaagcttcagcaattttcaacattttgctaaatgttttttagaaggacttttaattacagaaagcatttacatctttacaaaaagggatgaatttataggacctatctagaacttcctgtcccttataattttttagacttaaatttcaaggcctcacacccaaatttcagttttattctatcaagcccattttgttttcgcaaacacagatattcatatttctttcagttgaaagaaaaagctccttattttcatttgtacctcatacttctggtgatatcatctgctgaatcttaaatgttttgatgttcctattttttctcaaaactgtacccttgtaatatttattatttttgcttcattgtgtttatgtattttttctttatcagaataattttattctgttattcccatgctcttaagacatcaacccctaaattattttacagttggaaatctgatgttttcgtgtctcttaccgaacaattttctctaggtagaatccataattgctcttggtagcccatttcagaatttttaaagtacagttcctctttcctcttatgtacctattgcagcagtcatcaagtaacctgttaatcttttttttcccccaaaactccaattctctgatcttttttctcatggagctttttttataccttctcattaattgtgcacgttttagtgaatattcaagaagactaaaaaatcagtaagcaaacatatgtatatataatttctgggtattgaatgcccttctgttgtttcagctaaaaggaggtgataaaacttttactaacctttccaggatcccactcttgagtttttgtctgaagccgtagaagctcgtaagttaattctaaattttctaattcaggtttgggaaatccaggtagtacattgtgtaattggaaaccaaatagctccaaccaacttctgatgtctgtgagacacaatattaaaaaaagaaaatgaaaaatcccatactttataagctttgttgaaaacttgaaagatacctctcctgccttcaaactgtttaggcaatagaagttaggaataaaactcctatttatttatttatttatttatttatttatttatttgacatagtctcactctgttgcccaggctggagtacagtggtgcaatcttggctcactgcaacctccacctcttgggttcaagcgattctcctgcctcagcctccttcctgagtagctgggattataggcatgtgctaatttttgtatttttagtagagatggggtttcaccatgttggccaggctggtctcaaactcctggcctcaagtgatctgcctgcctcagcctcccaatgctgggattacaggtgtgagccaccgcacccagcctaaaactcccctttatatggcccacactaaaacacctgatcctctctctacagggtagagtgttgatttgtggataaccctggattataatatcagcttatatgatgaaacaagaatcctgaatttttcttttacgaaattattcatataagcttgtaagagtaaaacacagaaacagctaaaaaatgtagtaggatgcaaaagtattatatgttaacatgcacgttttgctcactctagaaaactaaggaagacagcaaatgcacaataacttgcgggctaactgtcaggaagaggaagcatatttacaaaggcattgagattctgtgataaaatcaacagtactgagttactcaagtttagcttaaagttttaaatagtttaaatacctgtggtatactttgcaacatcttgaattttgccaactgggtagttattttcaaaggagtagaggttgaatggtttaggaaggaggttcaactgtttccatatgtgatgattaggcgttgtccatctgccagcaacaacatcataatccctttgccccaggtgcactaatttagtaaggaaatcatagagtcctccatgaaaaccaataatgacctgaaagtcagggtaagtgtcatgatagatatcgccataaggtgtgtatagtatctcctttatgacctgacctcggctgctgaacacagctagtggggtacctgtattatcacaggctacataatattcttcaccactgcttaactccatggcaataaggtgaccttggagatcataatacagagatgtaatctccgagcttgtgtggttgtacaaatgagtaactcttatggggttggtaaggtctgcataaaagaactgaaggtgctgccctaggctggacttactcgcgacacgtcgcccaagcccatcatagtaatactgcacagtccagccagaagccttattgtaggctttctgcagcaggccattagaattatattcaaaaatatcatttcccctctgcctcagaaagccatcttcatccattttatactgaatttctcctaatctggtgatgcggtctcggaggtcatatcggagaggagtaagacgagcactcttcccatggcttaagaggttgatgtttccattcagatcgtaactataacgccactgggttttgtcatttacagaaacagtctgaagttgcccatcagcatcgtattcatagaagtaccttgttatattggcatctactcctacccttatgtcacatattaccatgcggcccacattatcatattgaatggtcatccagtaggcaattgcctttaggatttcatattggacttcaatgacttgtccattggcactgaagattttggtgtgtttcatcactgtagtagttatgacctgatttaaatcgtaattaattacactgaattttccaaactgctctgttctgccagagacatcaacatatcggtaaagatctataggcaaaggggtttcattgattacagcttgcatgcttgtgactcggaaattgttgtagctgtagtcgaaccgtgcattcacaaggccttcttcactgaatctgaaaatctggcgtccaataagaggtcctgcaggaaccaaaacaaaaacagtaagaagctaggcgatcaatgtggaagagtcagaaaggtctagtgttattttatttagtactggtgcttttatattcataatacaatattagagactgatctctgatatcaaatgcctgggcatattacctcatggatatatattctcatagtggtaatcctcaaatataaaaaattaaaatactctatagttatagaaaattttaattatagaaactacagaagtaataacacatccagtagcccagggtgatgaaattgatacttcttgctataatcactgacaaaaatgctttcatttcatttaacctttgctacaaagtcagagggtcaggttttgacaaattccagcattaaagtaactggatttgggcattctataaacccaaagggtgaaatacattagaaagttctgacttgtgaagatattttgtcatcaactgaggcttataaaggttacacagggcttgagctagtttcagtgagacttatatcttgccgtttcatctttgagaagatttggtgctgagcaggaatgggtatacagttacactaggcacttggatttcaaattacttgagagctgaaagaaagaaatgcactatatgtttttaagaaatcagctttcatcagactataacatgctttacattttcaatgtcagataatttgataagtaaagtgaaagttgggttgaatgtgtgtagattaatgcttctatctcacactgtggtcagtaaaaatgtcataagaaaatagtgatgttgttgtacacaccaccactctttcacaacaaacctgtttgcctgtatctgattgtgcagatgaatccgtcatgcatcaggtgtattgtcttaatcactccagaagactcttcatatgttaatgtgacctgagtggtatcatagagaacctcagaaagccttgcttgcttggtgtacttgtataagactctgcgccctgtccccagatgcagggtctgtagcaatcggccatctcgactatagtcttggataaaagaagtgctactgtccggtggggtgtagatgttccggtagtagcccactgaaagcatggtttgtaagctgtgacgcaccatgctaggcatggtgactgagagcagacaatctggttggtcatactcaaagatgtaacgccgctggctgtgtaggagaagcatcacagactgaaacgagacaaaggcagaatagcatattatggacaactaaagttgaggcgactaaagaaaatacacattcatccattcaacacaaatcaatcaagcacttactgtgtgccagacactgtggcaaaccctagtggatacagtagtgcacaatagtggtgtctatcttcatgaaatttacagttttaatggaggagaaagacaagtaaccaagcaattacaatatagtgtgaaatgtgttatgacaggggagttacagagtgcttctggaaggcagaggaagaccagcttactcagacttgagagaccagaaaaggcttcttggataaagtggcatctgagttgagacataaagattgcctagggattgtccaggtgaaggcagggagccgggggcaggggtagggaaagagtattcttggcagagagcacagccttgtgagggtctggatatgaaaaagaacacggctttttcagagaatgagagaaattttgtgtggctagaacttgagtatgttgggagtggtgggaatggcaggagatgacgtcagctatgtaggctgagtccagatcatgctaggctttctaagccacactaaggagtttggattcaagtatgttggcaacagggagtcatcgaagggtttctattttatttcatttttttagagccagggtctcacggtgttgcccaggctggagtgcagtggtgtagtcatagctcactgcagcctcgaactcctgagcttaggctatcctcctgtctcagcctcctgagtaactgggactaccaatgtgtgccactgcatctggcactcttgaagggttttaagcaagttaagggacggttgcaagagggcacttgcaagctgggagaaactgtcaagttggtattttagaaaggttacttcaacgtgcatatgtttcagaggaaggtaaatggatggcagggcatttcacaaattaatttatagttatcataaagtattgattgacttcacatactagatgtcttcctaaaaattgtgcataaaatattattatggcactattaatgttttgcaattgatgttttaacttcacatttccatttgtgttttaatattagggaagcatgtcattaaaactgaatgattctctggttatgcagcccctctcccccaaactgatctgtattttagaaacagttgtttgttgaggtataatgcaggtaacaggtgtttcataaatattgattgtcttgttttaattctaaatgcagacataaaaggagcactgttttagggaggactctaattgactgacatgtgcatctcatcttttaataaaaataaaaatttctcatccttggagattctgatatgactccctagaggagctttatccttcccctttagaaaattaccttttcaagcaaagagatttagttgagggttatttattcaagtttgtgttatgaaaacaataggtatattttcattttctaagcacaaattatataaatatttatgaatgtgaattacacaagtatatgtaatgtacatttatatcttctaaatatgacattacattctaatattgaatgtgctttctgaaactgcatatcctccctacccttctgagaattattgactttgaattgcatttcagtaccatgaagtcaaagtcagtggttatttgctcatttgttcattctttcttttccaccaacattacgcctgcagagccagaggtgagtgcagaaatcctgtcaattcgtcacttgtggacaacctgcagcttgccacagcctacagttccaccactgtgacctctgaaaacctcctgaacaaaaggaaggagacttggaaatcctgaatgggcttggagacattaagggagaactgcctccctggaccaaggcagaattcaatagaaccagcaagaaattttcctatgaatgggaaagcaggtggcagggggcaggggtggaaaagctttgtacaggaattgtggaaaagcttttgcattatctctagtctgaaagtcacatttctcagttcctttccactctcttctgtcaacttgctgtgagtaaatgacatctgtcacctgtgacacgggccagggactatcaccatatggcccccacacattatctagtaccagcctgcctgggccatgccttttccagtcactgtaccagcctttccaagtatttatggcacgtcgttgttattctctcctctgttcccatcctcctgcctgcagtaaaccactgcctgaaccgtgttcctaggtggtgctgatgctgggctgtctcaaaagcccttagtctgtttcaaagcttcctgccaatggcaagaatgtggatgatgtgattagaaatcaaatgaatgtaactgttacattgccaaaataccatttagctctcatttggctgctttttcactttgggtgggcattattatcagtttgctcaaaaacagtgcttatgaatctatccaatgtccacaatgctgttataggataaaaggccatttcttattagtccaaataacagagtgggagacttttattcttttaattgattgtgaggttctaaaagagataattgtaaaagcaacaacaacagcaacagcaatcatggctgtatgcttatttgaacaagactagaaatgagagcagaaatttgaaaagttaaagcatttgaatgaccaccagatggcagtgtggggccacctggaagctgaagccaaagtcgtcgttctgtctctctaggcagcctctgaaagtgtcagccccaaagaggcaattgctgtaaatgtataaggctaaagtatcttattaaatgattataaaatatatttaaatgcattttaaaaatgaagttcataagaattattttaggaaactgaaaggtttacatttactctaatacaaaattttagcccacaagtcttcaaaatataattaactcagagaagtctcataaatcaagacagagaattaatgaccacatagagaaaatttaagaaacaataattgatttttttaatagggaagagatcattaagcaaccacagccattacccaaataattatttttctcctaatggctacaaccattgtgcatgaaaatgatatgcataagtttcacttactctagaagaagtcaaactattttcacaaaatttctgcgtgttaaggtgaaaaatctgctgctgctttttaatacatcgtgacacaggtatggcaagcgaattcacaaggtaataccagagtattttggggtgtaaaaagagaaatccattttaaagtttgagaattcttagtttaaaatatactacaagaacgagcctctttatccctgctctgcccctgtcatagtgggagaatgtgccacaaaggccatattaatgagaggactggaaagaacacaaggagatacaaaacctcaagtcagtgaaaaagttacatgttacatgggattttggtaaattcaatgttctttccctttttccctctagaatcacaatttcaaagatgctttaatttcctccctccctccctgcctccctcccttccttccttcttccctcccttactttcttctgctctttcttgttttgatttacctccaagtggcagtaagtgctagctagcatttaaattctctacttgggtgttttatattaagttatttcatttaattatatctattcagtgaattagttatgattactggtaataataatgttaataaaatcaattttatgacaaatgacttttggaaagtaaagaatcgttccataattatgcgttctgtaggttctgagttttgcataacaggactgcttaaatcagtagctacccttttaattagagaacaaattaaatataaaatcaagaaaggaacaaaagtgaactcaaaggtacaaataagctggtttgtctcactggtcagaaagttaccaggacttgtcttgataccttattctgggtgaggaaggtcttatttttgtccactgcagacactggcagtctcaccgaggtttttgtttgtttgcttagcaattattgccaactacgtttttgtagcaaagagaacttgtgaagtttgcttcacgtgattctttgcttaagtaaatttgatggaataatcagtgaattcggaaaagagaaacaataaaatctcctcattggtgtcagagaagaggctaaataactgcacccagggatgaaattgaagttttcaataggctcttatgttattgtgcagatagtctaaagggaaagtcttttttttattattatactttaagttttagggtacatgtgcacaatgtgcaggttagttacgtatgtatacatgtgccatgctggtgcgctgcacccactaactcgtcatctagaggggaaagtcttatgagacctagatgtgactgtctataggcaattagctcagttggtcggactctggtgccaatgaggttggaattatgagtgcaatcctacgtatgcttctaaggagtgctggctacttaactagtcacatgggggacctgtggaaagattggtgcaaacctgtcttcctttctgaaaaactaactcagctaatattctgttagtgatcagtagcactgtttttttcatatgaaggtcatcaatatacaccttaagaaatactttgcctatgcacacataccagcaaatttttggattcagttaatgttgtaacaggcttggcattctgtaggcactagtcacacggttttgccaatcattcttgttaccaaaattcaaaagaggaaagacctgctctataagattcagattttgccagtgtagaggatagattatagatttgataaatatttctagcaaaaaaggacatgaggtggattcaccaaaggactccttccttttgccctggctcccaagtgaactctgcttcatctccaggcatttccaacttggtaaattctccagcaacaaactctgggaactagtaacatggtttgataatgacatataaccactggcacactatttttgtttaactttggggagggcgtatcagaaaagttgggcattatttggtaccaatagggaaatctgtcatgtgagctatgagctcctatgacttctctaagaacatctagaagctaccttgtactgattacccttgaattctcaagggaagccatttttcaatttttgtagaaattaatttaggactgatgaattcctaaatgtgttgaaagaatagatttgggaaacaagaggcactatcttaggagattagacattgagatagagatcaattactcttactgtcctctggtaccaatctggccagaaaccattttgctctgtaggggctgatgtttgacaaatggttcctgtagtgggattaaaatatttttctattattcccagacacaggccacaagctcccattatggatgctactggagactcagtgtacagaaaagagtattaccaatgaggccccactaccaccattcccgcaggctgattacttttggaaattagtcttcaaatgtatacaactaaaacttcactgactatcctaacaaaattagaattgcttatcctctgggtaaaaagccctttaccagagctgagtacattaacacaattttataattttctagctatttttccctcggtatgagctttcataataataaagataaccttttcaaaagcatgaacaaagatgttcaaatgaggagaaagctaagccgttattctgactttagtctgaaagagtacttggcagagtctgggactggggaaaattttcagctgaaaaacagtttatccttataagttcaacatctttttgttacttctacagaacagaacagctggaacacagacttttctcctgcaggtcctcaccaagatggacaattagggccattttcgatagtctcattcagaaacttgaaacttgtctttttcccctatgtacttactttttctaagtaggtatagctccaaattttcccatcagcccaagttcttgaaataattttcccactctggtcatattccattttttcattccacgttcctctttgaataaacgtcaccaatcccgaaggtgaatatgtgatgttcacttcattatatctgcttacaggagaccacagaatgggtcgcccagtctggtcataaagaattcgaagggtgaattttcgatggtcatcatagatctttcctgtgcgggttatatgatcaaaatctatggagagtaggtttctgttgtgggcctatgagaaagagatatgaaatacattttaagcacagccttgttcccctcattagagcactgacaatcatgaatcctttcctgattatccaacgatagagtctgtcttgcctctgaagcctcacggcttcacattccacagatgccacctgtctttattcctctaccacattgtacactctcagagagcagggctatgtcttaagtacttgaaatactctagactctcaataggtggttgttgattgctttttccccagctcaagccttaagtgcagtgccacagttttcagtaattatgtgatcttattttatgtaagtcagttgcctactaaggagtgggtattccttcacccttttcaccagtgaagtggccataacataaaagggtgaattatttgtgtgattagaaatcagacaaaaggaatacagtgagccccctctaacttatacagattcccttctttggtttcctcattcacctgggcttggagttttatatgatttcacacctattataggggaactcaggttgccttgccctctagttatggaatctcacttagcaatactttcacggaggcctgtaggtaaatgaactaagtgttggtaggtcccccagcattcacaagggcagcaccactaactgtggttaaagcacagagttaagtttggattccaagtttagaaacagtactttcacatgattctggttctagactttttctaccgtatggtagcattttctctgggcacctcaaaaccttgtagcagtcccagagtgatcctgattcaagggatcttgaactggattccatgaaagacagtattcaacggtgcctgactgataaaattcatctgggttcacacaagataaccaaataactaaatgacttagtaaaaaaaaaaaaagtttaaaaaatcagcagtgggacaactgacctgattttttccacgtttcagctggtagtgtcagtgtttgctagatctaccagtaacttctgctatgggtagctgattacaacacaatcacttagaaaatgcaatcctcaactgtttttttttgtgtgtgtgtgtttcagaaaaaaaaaaggtgttcttgattttagtcattaagaggttcagtccctgctggccagtgcactgaagaaggccctgtggaagaggggagctttgaagaaggcataggtggaaagtgcaggaaggaattttaaaatttattttattttagcttagctcagtttagttaagttttagttttagtgggttttatgttttgttgtgttaaaactttttatttttacatagtctgactcacaagaagttgcaaaaatggtagagttgctgtgtacccttcacccagcttttaggggacagacttctgatttgggtggagagagtcctagtgtatccggcaggaacaaaaacaagaatgaaaaaggagagactttgaggagtctaagtagcagtgaactgcagtcaggagacattcaaactagttacttgtctgtgcaccagtcatttcttccatctgcgccttagttttcttatctgtgaaacaagagtgatgttaccactttacaccacaaacttgtgctaagaattaaacgatattccatatacaggtacttggtaagctgtgaaacaacactagtaattgttatttgtataacataatgattacttttctcattttatttaggcttgtgaataggaccacatttcagattccaaggtgattgtagcttagtgtactagatttatatcggtaagagttgtcaacatgatcctgaatgaaatgttaaatatcttgttaatgaaggggaggagtgaaactcacattaggatttgactacattaatcatagtcagattaaactgattcactagctactcaactaaacttgatgttaattttaacttttgtggtcaaggatctgtttaactatctgaaagctatgcaatgtatcccaagaaaagtgcatataaaatgcatatatattaacatttttaatatactcttaggggggctttgaacctttctgaaaaacctaaacataaaaccttttcaggtctcaggaatccaagatcaacatcctggttcagaaagagttttgatcttagaggtctggatggctgcaaagctaatgctctcataccagactctggtcttcctttgttcagaatcttgtgctctttgctttaaaaagtaacctttccctcccacccccaaatataaaagagataactttttcatggcagaaaaattagaaatatagaaatgtacaaaggatataattacatgtaatccaaccatccaatgaaaatcactgttaacacttcactgtatttcatttcatttatcttacttttttggcataatctctgtgcatacatttaaaacatacaactaggattgtatttaaagttttgtgtcctactttttcagctaatgttttatctttagcattccttgtgttattcaatgttcttaaaatatactttttaatggttgcatgtcttactacatgataaacatttatttatctattctcccaattagaaatcagaaagtagtttttgtttttctctttcatattgcatgttttgctgaacatttttataagtaaatatttccataatacagaaccctatgagtgaaattactgggtcaaatgagacatgttaaaagacccctgatgcaacctgagagattactttatagtgcacagaggttgtataaattcatactcccattagctagtagtgggagaggctatctcagtccatccttactagcattgagtattatcagttaattaacttttcccaatatgagagtgggaaaatgatatgctgctgtggcttaaatttgcatttatttgattactactgaggctgaacactttttaacatctattggccacatgtgtatcttctataaattgtctgctcatgatatttgcccatttttctattggggtgtgacactttcctttttaaacctcttttggtttcagtttcttcattggtcagctggggctaatgttatttgcccttaattttgaacttctgaaaaaaaaaaaaagaagacctaccaaatgttccatgccatgaattgtatctggaagactagtggttagatgcttaaattatctgggggcaagtgccgtttgtgtcaggggtaggtttaattcagggagtacaaccacaaattgggactcttgactctttataccatctgtggccaatgcatgcagtgttgtcttgcatacatatacagccacctgttgttatgtgcttatgtgttgttatgtgcacctaaaaggtgataagaaaagcgcatatttcctgtcttttgatacaacgggcctggaagcctataggaaaccaggtgttcttgaactacccttcctgtggtttcacagccacatatctccaactgtaatactgttcatttacaatagctgtaaaatatccatgtactcccagagatggttgtaactgttgcaatttatgctataatgatagttaaagagccaaagtaacaagtgatttccagttcaactaaatttgtggttttatttgtctgatagattaagtttactactcaagaacacatttcttagtaaagtcattatagctacataagcagggatcactgtttaaaatccaccacaaagcaagcagaggacaactctgcctaatgttctttctctgcctgtcaagacgtctgccgctgtgcttctctgtttatggataatgcactctgatattccagtgctgctgaaacactagtttcaaagtcaggtttggaagttaatgtaaaattcggctaagagctaaaaaagaatgaaggaactgaagatgccacaggttcctccctgagtctcctggggaaaccatgtgtgagaagcctggcaaagagaatgcttttccagctgagcctctcccaaccttttttttttttttcgagccggagttttgctcttgtcacccaggctggagtgcaatggcacgatcttggctcactgcaacctccacttcctggttcaagcgattctcctgcctcagcctcccgagtagctgggattacaggtgcccgccaccacgcccagctaatttttttgtatttttagtagagacagggtttcgccatgttggccaggctggtctcgaactcctgacctcaggcaatccacccacctcaccctcccaaagtgctgggattacaggcatgagccaccacgccaggcctccaacctccttcttgagtgctcacgtgccaccagcctctatgataagaataagaactaggctgaacactacctactactgggtttgtgggcaaggctgagaaagctccacattcatacaagtgcttgctttcctgaaagatgatagcccttgacctaagtgtggaccatcaatctttatttccactcttgtttcagtattcaatctacactaatcctttccctggaaaagagaagggggggaaaaaaggattgaaatttgggaatagctccaagttaaaaagggtatctttggatagctgtgcattgaataaaacctttgagtttggcaactgacaggctgtgtggtgtggtaagaaaactgtttggtaataggtttttaataagggaagatggatctacgctgtaatgcatccttcggtttcccttatgtttttttcagctatactaggagacaggcctgattgttgttcatactaggaccagagaggaaagagggaagagtgtgctctggagagccacgaatagtgttgctggcagaaatgaaaaggcctgtaaaaagagggtatatggggaaaagcaaagccctttcctgctctttctgaggactttgtgttctaattgttcaagagaaaatcctttcaacccttctgatttgaaagtcgttcagttagaaaaataacattgtactacgttgatctaaaggcaattggtgatatttagctgtttttgacctacacaaagggcaatttgctatggttcaaccaactacacacttgcacacccacgcctgtgaatgtgctgaactctgagctatgatcactgcagttgattttctcccctccttaaggaggagaaggctgaattttcaagaacactgtcactagacaactgtgttacttgtttaatttttgctgaagaagttggaaggtaaataagtgagatgggccaaatagccacgtcagagtttggaagatcctgcatttaatttttttgtttttgtttttgtttttgagacagagtctcgctctgtcgcccaggctggagtgcaatggcatgatcttggctcaccacaacctccacctcccgggttcaagggattctcctgcctcagcctcctgagtagctgggattataggcacccgccaccatgcccggttaatttttgtatttttagtagagacggggtttcaccatgttggccagcctggtcttgaagtgacccagtgatccacccgcctcagcctcccaaagtcctgggattacaggtgtgagccaccgtgcccggcctcctgcatttaatttttatgaagttgtgagaatggatagaaaagtcacagttggggctgggcgcggtggctcacgtctgtaatcccagcactttgggaggcccaggcgggcggatcacaaggtcaggagatagagaccatcctggctaatgcggtgaaaccccatctctattaaaaatacaaaaaattagccgggcgtggtggcaggcgcctgtaatcccagctactcggaaggctgaggaaggagaactgctcgaacagaggagacggagcttgcagtgggccaagatcgcgccactgccctccagcctgggcgacagagcaagactcttaaaaaaaaaaaaaagtcacagttgatcttaaaaagtaccacatgctactttactctcactagttttaaggtaattagtatttgatttttagaaatcaatcactacattaattccacagatttttttttttattggtatctcttggtagacaatcaaaagcttacttaagcctacttttatttcacagagatgcctaccaatgaacagggcatatgttcagtactagcatcagcctctaatatttcacctggaattcccatttttttctttctttttgaaagagaactaaacttacttttaaaatagatggaataaatgtataatttctctagacattttattctttaaaaattatttcatatttaacaagaatcattgtatgacatttatgcaggattttctttttttctttttttttattttttggtgtatatgtgctttattattttaaaatcaactttatttggatagtttacacacagtaggagtcaccaattttaagcgtacaatttaatgagttttgacagtcattgaatcaggtaaccactaccacaatcgtgatagcatttccatcacccccaaaacttctcatttccctttacgtcaatttaacatccccaccaactgttttgtcccccatgcaggattttcaatcatttgtttacatagtgatagatttctagaaaagtttacatgacatcataataacctttgacacaaaactgcttgagttagaaggaacccttctgttcactcttatccgactacccactgtaatttacaatcacatacaactagttgtttctaattcttttgaagaatttgattcaataatataatgttttttactcccaagacactccctttactttgccagcatatagaaccttatcaacagaggggatcttaggaaatgggcttttgagccagactgcctgaattcaaatcctgtgatcactgcttactagctgtgtgacctctctgtgcctcagtttcttcatctgtaaaatgggaatgataatgataaacccatctggtaaggtgttataaatagtaaatgagttaatatgtggcagtatacatggtaaggcttcaaggaatgctaattgctgctgttatggttaatactaccactaataatatattgcaccatccatgtccctctttttatagatgagaaaagtgcaaaattatgggcataccagttcttcctcaaaatcatactcatttttctcacccaactttggctatattatttaccttggacattttttgcactatgctaatttgcccttgcttaagtactttgctgttgaccaattcatctgtgtaaccatacaacagatatttaaaatttttttataccaaatcattaatgctcatatacaggtgaaatggtatatgaaataattctttctttctagttatcttagtgaggttgatccaagattaacaaaaataggctaggcacggtgactcgtgcctgaagtcccagcactttaggaggctgaggtgggcggatggcttgagtccaggagttcaagaccagcctgggcaacatggcaagaccctgtctttacaaagaaacaaaaacaaaaattagccgagcacggtggcatgcgcctgtagtcccagctactcaggagactgaggtgggagattcgcttgagcccgggagttagaggctgcagtgagccaagatcgtgccactgcattccactctgggagacaaaaaacaaaaaaacaaaaacacaaccaaatatagcaggttctatgatttggaagccccaagaattcctggaccccaaaaatcaatactgcccagtagccttgatataggaaatctcctgtctccagggggctccttagggggaaaagcactgttacttgactgaaaactgcagatatatttttaaatagattaatctgattaatatatctccagtcaggctccttatctaaattttcacaaaataaatgcttccaccaaacctgaggagaaggaagttaaaatagtgtcaagtgaatgaaaatccaactctgagcaccctgtagctgaggaccaaggcaatttctcagaatagagggaaaggccagagccctcttggctgcccccaccaattccccatcatttgtcagcctgagaccctgtgttcaaccgagcttgtttctccttctcagctcacatctgaacactcacgtttcatttaaaaaccaacctaccctattctcagttatgtttgagtagaggaaaaaagtaaattgggagagttttagataagtccttgcttcatttcatttgtaaacacataataatcctacctgattttataattttggtcataaagtgctaagccccctccattgtttttcttttaataaaggaggctgcagttcagggattttgctataaccttacaactcagtctacaaaatcttataaacagctctgggatccaaagctgggatacatctcatatgacagcattgttatccatggacatagcaaggtacaaactggatgtagttcctaaaccagtatgcttttggtaaatgcccaattctttttacaattgcctctattgttatctgcactctaatttctctattgtccagggaaatgtatttatggggacagattgatgcagcagataagcagatacatggactagatgcaaaagtgccttgcaaggaaggaagatgagtcaaacacaactcaggttggagggaaatggattttttaaataaatgaaatttcaggatgttaatgtgacttatttcacttaatggagctggtgaaggatggctcagaggtaacaaatcccttgcctgctcaggctgagcagggtatcatgtttcccaaaagtttgcctccctcaccttaaaaaggatcctgacgttgcatgaaaaaaaatcactgattattctccaaagataggtctatccttttctgatttttttttctttccagctaaaaggtctgggggaggtgtgatcggcagcttttgggaacatttgacgtctatcatcttaccaaatgggcctttaaatgaacctgtcattttgtccttgaacaattagtgctttatggcctgcacacttgcaaattacaaccacacttttgtgtgggttttcaaaagggagccccatttcccacagtacagaaggggtttctatgttgtatgacttggaaattctgtctcaacagctctgatagctccacctgccctcagtctgaaatgacagcttcactagaagaaataaatgattcagtccaaggtattgaggaacttgagagcatcagagaagcttattctttggatgcttacaaatgggtcattgcatattttggtccaggaagagagaaaattggcatcagcttgtcccttgaaagctaccagaaatgaagggacgccatctcggaaataataacgtcagtgggggaagagaatttgctttgtcaaaattggattcacatgtcccttttgggagcatactcatttcattaaattggaaatgccaaatctggggaaattgaggcatcagcataaaaaaaatcactaggaatagggagatcgggtaaaaattaaccagttaagcagcctccttcctctttttgcctgcttcatgcttttcctgcctggaagccagccagttgtcctgtgcctcccacacttgccagtacattagagtcgattatttgtccctttttgtcagcattgaaatgaggagtcaggccctgccaaggtagctccactgagtggggcaatgatttatagattaattattttaaggaacaaggcagcacagtgtgatgcagtagaaagagtgccatgctaggtgaggacctgcattttagctctggctctgatccttaatagctggttgactttgggcaaatcacttaacctacctgggccttggtctccttatctgtaaattgaaagtaacaattgacagctgtggtgatcaaataaaatcctggctatgaaaccattttgttcactctgaggcactaaacatatgtaaatgattgttattgttattagacttctggggcatgccatggtaacaccacctggccaataaggggcctcatttttcagtcacaggacctcagggagtagcctagaagtgatatagagaagagggccttgaatttgttgcccttatagtccagtccgcaaatctgctcaactctgccacaggatcggaaatgggtcacattataattagtactaactaaacactttacttcttaacactaatgagctcccaaatgttttatgacaattagcttctcagcactaagaacaatttgggatatggggtgtaaattacagtttatagtttctctccattatctgtgcatatggaggacagaaaacaggatgggttgttctagaaaatggaaacttccaaggtcacataatataggatgagttatcctaaagaatgaaaaatcccaaagtcacatagtatatgatttggttcagaaagtttttttgaggctatatgctgggagaggtactaagaaatcatgtcttcaatacaatttttctgtgatgagtccatgaggtcgataagccatatgtagataattcttactttctctagtagtacacttttattttacaggtgaaaaaaaaaaatcaaggcatttcttaaagcgtttgtaaaatagggtatcaaggccaggttctctaacttccccatccagggttctacccaggaggtcctatttctcaaagaattccgatagaaatctttactgctacccacacattggtttgatatttggattggtttcacttctccattcagtggcatatctggtaaatattctgtcagaaacttgtcaatagaatcgaaacataaaaattgacttgtgcacatacaaatttcagtagctttataaaaaaaaaacccaaacaaaaccaaacaacaacaaaaaaaccacccactaaagtctgtggctgtgtgtcaccaagagaactgattgaaaagtgagcactggccgggcacggtggctcatgcctgtaatcccagcactttgggaggccgaggcaggtggatcacgaggtcaggagatcaagaccatcctggcgaacacggtgaaatcccgtctctactaaaaatacaaaaaagtagccgggtgtggtggcgggcacctgtagtcccagctacttgggaggctgaggcaggagaatggcgtgaacccgggaggcagagcttgcagtgagccgagatcgcaccactgcactccagcctgggcgacagagcaagactcttgtctcaaaaaaaaaaaaagaaaaaaaaaagaaaagtgagcactgctgtagattattttgttcatatcaagccatatgaccggtttgactgcctctctctggaattgggtggttgtttgggggttgcacttccacaaccttaaggttaccaaatttttgatatgagttctacatttcttttcaaataattaatatgtcagtatgttcaattctttgccttctacttttaaacttaacttcctcgtaaagcaacctttttcaattacctactccaccctgactcattccgattacctgctccaccctaaatcattcggatcacctgctctaccctaactcattcagattacctgctacctgctctgccctgactcccgccaaaacactcaccccgtcattctctttaaattagccaatcggaattagtttagtctgtgcggtctaaccctagccaataggggaacgacacagcaacacgtgcgtcagggataagagccccttcccctcccttgtccaagtgtgcactcaccattgctccatctgtaagggcgcacccttctatagaagtaacttgccttactgataattaaaaagaaaattttatattcgagtgctattccttttgcggcaccgaaactttatatataacagaaaccttcccggtatatcaggcgtgacacaggtgctcaaagcagatctggcctcaatagtgagtgattatttcccgcaggctggcagttgctctagggctgatattgaatgttactacatgtagaaagctggccacatcatcctaacactggttaacgttcaagaggaggcaggtagacagagtgctatggcgattgtaggctttgtgtgctgcagaaaagctgaccgaggtctcctggttaactctggtgaactgtgcttggtaaggactttaaaactccctaatctataacttcctccaggcagctctgagtacctcagcccaatctcagtaccagtcctttatccctctggccctggatatgtattcatggcaatgctataattcactgatttttcctcttgtctttgcccaaatgttgccttttgtctcacatccttttgtgtgtacctgcgaggtctttccaaagagctacctggaaagcagggacctcggtcaactcagtgaacctgatagacatctccagggcatgctgggaggggtgctggagggcctcctttgactaaacacatttctccagccagactttcttggtgaaattgctactattagagcactttagctggctaatgacaaagaaagctcctattagaatgctcatttaaggatactgaaccattatcggccattagcatcctcttttgaattagtatatcatataagccagtcagtcacttagaaaagctttggagaaatgggacttcagtttagggaggctctgcagttaaacaaacaaacaaacaaacaaacaaacaaacaaaacacctataaaagttctatatcttgtgtaaagtcaagccttaccctcagcctcctttcaaaagccgaaacattgcctttgttttgctccttcctctgccgccactcgatgaggtttgcattgtgctctccgggcaatgagatgttgcatttgcccagggtagggttgactgcccctgccaggatgtggggctctgagctgaggccgatctccatcccgctggcaaaagtgacacgcagggaaccatctggattcacccgataggtactttgagtattttctgtagacagaagagcaaaggaggaagagggggaaggaagggaagagcaggaagcagaaaagagacaggtttagttttaggaggcacgtttgggggataagcaggtggggtgctgtggtcctatctgccttctgggctagactaccgctctgacaggcaaacgtgttccctatccatttgggtcttgttattttcacagctggagtatctgtttcttggataaaagactcttgtctaacactgcaggctgtttttgtttttttcttttttcatttttaaagaattccctccctcactgacttgttggatcagcctcctcagtttgatatgctgggagctagaatgagaagagtgtgaagttcaacgtagcaccttaccacctgggcccaccatcacagttgccgtactccacaaaataccactaacaaaagttagtgtactcttagagtgtctggtgtcaccacctaacaacagaatgaggtcttaatgacagggcagagagaaagcaatttctctttgtgcacttgtcctctagcttctaagacattccaaatcctatctcccttccttcctttcttcttctgttcttccttacttttctgtcttcaaatataatgagtttttaattctctcatttcacttatattcttgcttggtctgtatcctaagattttcctttttcttcacccatgttggcattgatctagaatgccaagctcagctggagcccaggctccatttatttaatataacctagccagaccctgaaagacctttgcaaacagctgggtattgggaaataagttgatagcagagcagacttggcagggattgaacctcatgactcccacagagatgggcccaaagttgatgtgagaacttgtaaaaggtgtgaattttgtctgtgtttcaacttccatagctggaaaacaggaagagtacatcttctcagctagaggtgaattctgtttatgaatggtgtacgcaggtttcaaggtggatgttgacataggggctgttacagtcagatatcgttggaaacaatcttaccttgttttaaaatatatatggtactagttgccgtcaagttggttgacatgaggacattttcacggttggaagtatctagctccacttttgtcagcttctccaggtcactgtggaagctgctgacctctccagtgggaaacgttgcattggtcaggtgtccctcggggtcatacctgaggaatgtaaccaatcccagctttgaagcgtctcggcagtgataacaggactttgcaaaataaaaatcacttggcagctaatacagtttaactttgagtgataacaagtattattaaccttgttcaagaagaagaaaaaggtcagagagatgattaatcaaacgaaggtattttttgcagcttctgaattcttgataacttccttgagctgtgctgttttacagaaaaaatatatctggtaatgaatcaccagggtggaacactgatttatgaatcatgtcctgctgtgtgcaacgttgcagggaggcctccgtttgcgatttgggtcgatcccattagaggtgatggattacaaaacccagcagagggtgctgttgtcaaagcaaaagaaggtacaaaagggccctcaaaggctgagaagccaatatactgactttgggttatgatgggaaaattataatttgctgctgtttaagttgccaaatttgaaatgaatgaatcattcttccaacaaaatgaacaggcacagaggataatggaaacatgttcattaaaacattctggagccctctgatcttgatgtcacttaaattttaaaaatctttttagggtatagtacataaggttttgtaatttgtctatatgagtaagagacaaaaaataattacctgggataataggctataagctatatctagaaatatagtctagggagtttactttttccaaaaaaaaaaaaaaaaaaatcagaattattggcaatctcactgtcctccaaatgaaaactgcttccctgaaggcttttgatgtggagctgttcttttattgccaatagaaccatgaaaaataaacacttcattaaaagtaaacacatgtacttggaaacccattactgttttcttttcaagttgcaaattacaaaatatttaagcacttttatttgccttttaaaatgttaaacaattatattctttttacccaaaatgagcaggattcagcctggacacaatggtagagactggctgtactactccctcccccaacgattacacaaagtggcatagtaattcagtatcaatccattatattctaaaaaactcagcctgggtagttgctcaaattttaataactataccagcctttggaaggcttgggaaaagcagttggactgtactttataggacagacttgaacttgagcctatacataatgccacctaaagttcagttctgcatatacacgtgcgtgtgtgcacacacacatatatattatcagttaaaacagtcacatatgtgaatagaatgaatcaaataggttattgacatcacagatatgcctagccttagatgttaaattgggtgtctcctttgtttaaatggatttcagtcgaaatggttggcacagtgctattatgcagctaaggacgcgttatcaaagaaagactgaagagtgctgtttcttcctggggttaatggcaaaatccttccctctgcaaagactgcccacgttctgcctgctgtggggctctatagctacaagaagcagaagaacggagcataggaaggctcgaatacccactttagccccaaccttgtctgtttggtcttccatccaggggagaaaaacaataatatccagccttttttaaaaaaaattaattaatttttttgagacagtcttgctctgtcacccaggctggagtgcagtggtgtgatctcggctcactgcaacctccacctcccgggttcaagcaattctcgtgtcctagcctccctgagtagctgggattacaaacgagtaccactacatctggctaatttttgtatttttagtagagatgtgttttcgccatgttggccagactggtatccaactcctggcctcatgtgattccccctgcctcagcctcccaaagtgctggtattacaggcgtgagccaccacgcccggcccactgtccagccattattctcccaaggtagaggaggcaggagtttgcaggcagtagaccgaaggaagctgctgcatgcctttcttatcaggggaactgtggccccaacaacctggattatgcaggcacttcctctctgttccacatgaggcaccagcaactttgcctcattggtttccctttcctgatttctttctttctttctttcttttttacaatagtaaaactttttttttattattatactttaaattttagggtacatgtgcacaatgtgcaggttagttacatatgtatacatgtgccatgttggtgtgctgcacccgttaactcgtcatttaacattaggtgtatctcctaatgctatccctcccccctccccccaccccacaacaggccccagagtgtgatgttccccttcctgtgtccatgtgttctcattgttcaattcccacctatgagtgagaacatgcagtgtttggttttttgtccttgtgatagtttgctgagaatggtggtttacagcttcatccatgtccctacaaaggacatgaactcatcgttttttatggctgcatagtattccatggtgtatatgtgccatattttcttaatccagtctatcattattggacatttgggttggttccaagtctttgctattgtgaatagtgccgcaataaacatacgtgtgcatgtgtctttatagcagcatgatttatattccttcgggtatatacccagtaatgggatggctgggtcaaatggtatttctagttctagatccctgaggaattgccacactgacttccacaatggttgaactagtttacagtcccaccaccagtgtaaaagtgttcctatttctccaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattagaaaaagaggaagtcaaattgtccctgtttgcagatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggaactcttcaaggagaactacaaaccactgctcaatgaaataaaagaggatacaaacaaatggaagaacattccacgctcatgggtaggaagaatcaatatcgtgaaaatggccatactgcccaaggtaatttatagattcaatgccatccccatcaagctaccaatgactttcttcacagaattggaaaaaactactttaaagttcatgtggaaccaaaaaagagcccacatcgccaagtcaatcctaagccaaaagaacaaagctggaggcatcatgctacctgacttcaaactatactacaaggctacagtaaccaaaacagcatggtactggtaccaaaacagagatattgaccaatggaacagaacagagccctcagaaataatgctgcatatctacaactatctgatctttgacaaacctgacaaaaacaagaaatggggaaaggattccctatttaataaatggtgatgggaaaactggccagccatatgtagaaagctgaaactggatcccttccttacatcttacacaaaaactaattcaagatggattaaagacttaaatgttagacctaaaaccataaaaaaccctagaagaaaacctaggcattaccattcaggacataggcatgagcaaggacttcatgtctaaaacaccaaaagcaatggcaacgaaagccaaaattgagaaatggaatctaattaaactcaagagcttctgcacagcaaaagaaactaccatcagagtgaacaggcaacctacagaacgggagaaaatttttgcaatctactcatctgacaaagggctaatatccagaatctacaacgaaccccaacaaatttacaagaaaaaaacaaccctatcaacaagtgggcaaaggatatgaacagacacttctcaaaagaagacatttatgcagccaaaagacacatgaaaaaatgttcatcatcactggcctttcctgatttctaaagggattcctcaacccttgacaagctcactctatcattcctccaggaaagctgaacttagatgctgtggatgcaggttccacatggactttccagcttgggggcagtttccttcagtcacacagccccttgttttaagggaagatctcatgtaaagatatgagcagtggttatatccactcatcagagcaagatgacaagatcagataccaactgggccatccatgcataggggtacaagggtcaaaattcccaatgaacctttgcagtgacctgtggctaaatctggtttcctagtccacccacccaaacaccttttcagctaagttattggtggtctttgtctgataaacatttcaaagcttatttccaagagcacaggcatattcctacatattttgtacccatccctcctccccatattgacggtggtatattcagagaggcaagctaaagattcctagataagactgtaattacccagatagatttagctgggagactgcttggtgtatatgtgtgtgtttgtgtgtgtgtatgtgtgtgtgtgtgtgtgcacgcacgtgtgtgtgtgttttctggtgaaggaggcaatggtgttgggaataagatatttcccatgggtctgtccagttgttgggtagctggaaagttatattgcctcatttcctttctgtggccagagaggccaatgaaagtgtacatttgactgtaactccatgataaacaaagcaccccaactccaacacactcacataccccaattctgctagttcacagttaaagcaatcacatttaatggtatctgcagggtggtgtctctgatgctcaatatggccctggatcaaaacatacagatcccacctctcttctgttgggtcatttccaaaggaagaacaacaggcagatgtacacatcagcgggtaattcctacaactttggaaagattgctcaaagtggataagaaatagagcgagattttgatttcttatagcttacttgagttttttctgtcatcacaggggaatgcatctttccagactgagtgtcgaagaaacaagtttaatcaaaatctcttctgctgtgtgtttcccttcggtgcctccatcctttggtgcagagatacaagccgatatgctccaacgaatcccttcaggccacagcatgggagcaaacccaccctctttgcatgcagggcacagcactcacctaaccaggctgcaaattatagctgctgaattgtgccatcaggaaatgacagttgccttcatagccatcagaagtggatttggtaagaggagatttgttatcaaattgtcccttgctgtcctgattttacagagttccactgtgatggtctcagagggtaccagacagttaagtaatgagtacactcacccttttcctcagcactgtcataggctgtgtgcatgtgcacttgagtgagtgtgtgtgtgcatgtgcacacatgtgcaccccagtagagcaaaggaaacatttgtaaagaaaattcagaatccattcttgtccttgagaagcatatagtttagttggagagatgatatttacacatgattaaaaatatatttggcctggtattttctcataagggatagcttgccctttcctctgaggacaatttaagccagagttaaactgttcaagataaaactagaggctcccacacctttgctttaaaaaaaaattgcagataatagaagagaaattcattacttactcttttaaaggaaatatgaaagagtcagaccctctttacactttcatgtcagaaagctgaccaacctaataagaattctttaggaaatatgggattcccctttcctcactaataaattcctttggcttcctatgattcagttccaagtccataatgtccttctatcttcatttgtccttcattcaataaatatcagagtcttgtgctagggaccagggatacagtgctgaatgaaattcacagtctagtggggcagataagatatgcacacaaataactctaatgccagaatattgccatgaatttctgtaaagaagaaactagaatctcagaagaggcaaaggtcatttccagctgggctgagcagaataggaggaggaagagcagaagcaggtggtgtttgaatcctagaaggtaggtagagattgggaaggggaggaaggcattccaaatggaggtatgaagaaaggcacgctgactgatgggatgtctactgggggaccagcattgctggagcacagggttcctctaggagggtagtgagagataaggcttatacaataaagaagcatagacagtttttcaaggggataaaaggatgatccaaacagtgttttggtggcaatgagtcttggaaggggaggcaaggagcagggagaactgttaggaggctgcagacccagttcatatatgagaagatggtggtctgttgccttcgttaaatatattgtgattgcctatcattcagatttgtcttccccactagactgtacaactctcacatctttagagggaggacacagtgtctcattcatttttatattctccgtgtctggaacagagtagatctcactccatgtacttgttgaatgagtataaataggatgctgccagtgaaaaaaaggatgggggtggatatgagagccaatgtggttacagaacagacagaaccatcgatagtgcttctgggagggcacactcaggttacatagatgtgctatggagttcagcggaacttccctaccagcttctgttacttctgttcactctgtctttatttcagttcttcccagaaataccgacgataattctgttttactcactcttgatccttatcaagggcataaagcacaaggagaggtgactgagcaagggtgtcaactctctatttctaaagatctgaaggaacagccaacatttctatgttcttgtttaattgaaatcattcacctgcctggaggcatgtgcctgaaccatacaatgccttagttccttttctactctgggattctagaaggcattggaaacgtcacatgtgtttagaatgactgattattacataagcatttctgcatgggaatcgcatcctatccccaggcaaatatctcacccagagacatggcttgtttatcttgccccctaccccttctgatcttataagggagaagggggaatctgtcattagccatccatgataaaactgggcatttgtaaaacagtctagaagatacccagagatattatgaaggcttctccaacctgtcagtgggtggtgtttttgtttgtttgtttgtttgttttttgttttcttgatgggaggagaggatgtgttaataaagtctgaaaacagagaatgcagaagacgaaggatcaagagatcatgtaaacggagagtctccttcaagtgggagggcttcccacaaagggcaaggggcctgacgaaccgtcaactcagaatggaccagcagcagtgacacgactgatgctttggccttagtctgggaccttttcagtttagtagagcagaagcctttgccagggaaacaagcaagggcatcctggctacttttgcagccttgtggagaaaggcttgtctgctgtgcgagttgctaggcccctccctcagatctcagctgctgcggggttattacaattaggagcccacctgtgccgcctcaggccagtattcgtgccttgacaatcacttccttgttagctgtttctctgtggtcagcttttccccctgacacttgggacactcatgggcaatggtgcatcaaatactaacacttggggtgtgcaattttgatcctggtccaagtcaaatggaattatgaaaattagtgaactatgtaaacaacatcacactacctaataaaagcccaggcactaccactacacaagatgcattttaaaatcccatttggattatccactgttcagggtcatctatgtcatttttcctcctgatagctgcagataatagaaagttgaatggattagtgactggcctacctttacactgcagtcttccatcctgccaaatttcacttctgtttctgtttctctcatgctcctctcagagcagaacttatacttccacctgtgcaaacaatttgtccccttgtccacataaagaagcctcccttttacctcggggaattactcgagttcttttaggagggcctggtatcagtggtatagcagccttctaccgaccttagcactgctctgaccctgactagaagagtaggtcaaatgctgtgttctccaacttcagaaggacaagagaaaacttgaaggagtgctcagaactagccaaaggactagaggacaaaagtgaaaaaagtcagatattgtataaagactgtaggaggaattagtcacattatgaaggttggaaagttgctcatttctgtttacaggcaagaagggacaggagctgtgttttgttaaagactgctgttcagcaccagaatagactgcttcaggagaagaggtaccttctcctttcaacagatgctatttgaccaagagggtttcagtataattctggctggagttaagaaggtgggagaaagaacaaatggttattcagcctcccttttcatctcctggtgctacctattcctcttttactgctacttgaggggaaactttctagctctctagattttgtatggtcactctcgtaagcccacatgatcctctgttttctgttatcctgactctggataagccaactagcatgtgaatgggcacgttacttccctattctgggtttcggtttcttcatttgtaaaatgacatctaatgtctctttgtggccataaaatttcatgactacccccatgtggatgtctgtgtttctcatagcttagtggctcgagattggttactcaccaatgatgttagttgataccttttcactcactgttggccaaattctggtaacaggcctggaccccattcaccgtgagaatcttgcctaccacacagtgcctgcatcaatgtgatgccagtggaaaacaggcacacaaattgatatgacaacaaaattatcttctctcttcagcatcatcaattttcccctctatattagatcatttttatcagtatacaaatatgctgttatttctctcacttaaaaaactcttctgtttactctgtttctcctccagctctaatttctctgctctttacagcaaaactcctcaaaagagttctttactcactgtctcagtctctctcctcctagtcattctatattattattattgagatataattctcacaccataaaaatcaccattctaaattgtacaatccagtgacttacagtacatttgcaatgttgtgcaaccatcaccaccacttctagaacatttctatcacccccaagataaaccccatatgaattaaccgtcactccccattcattcttctccccagctcttggcaactacaaatctattttctgtctttatggatttgcctcttctagacatctcatataaatggaatcagaagggtcctttgtttctagattctttcactgagcataatgtttttgaggttcatccacattgtagtatgtatcagaacttcatttctttttatggctgaacactatttcatgacatggatatatcacattttgtttgtcttctcaccacttgataggcatttgagttgtttatatttctcagctattataaataatgttgctatgaaaatttgtgtatccattctctcttaagagaatattctactcaggctttggtccctcatgtgtcacagcgcctgctcttcacagtgctaaatcaagtggtcaattctaagtcctcatcttacttatcaggagtatttggcacagtggctcactctttcctcctggaatcacctgttttatttggtgctatggtctgaatttgtccccctaaattcaaatattgagactgaactgccgatgtgatagtactaacaggtgaggcctttaggaggtgattaggtcatgttgtctctgccttcatgaatgcaattagcaatcttacaaaagagctggagagagccagctaggtcccttttcactgtcccccttctgtcatataaggactcagcaggcagtgccattttggaagcagagagtagccctcaccagacactgactctgctggcatcttgaccttgaacttcccaacctccagaactgtgaaaaataaatttgttcttgattaattacccagtaaaaggtattttgttatagcagcacaaacagattaacacagttggcttccaggacattccactctcctagttttctttccacttcactggcctttccttctcagtgtcttttgctggttcctcttcataccctcaactcttttcttctctttctttttttttgaaacagagtttcgctcttgttgcccaggctggagtgcagtggcgccatctcagctcactgcaacctccacctcccgggttcaagtgattctcctgcctcaggcctcccaagtagctcggattacaggtacccgccaccacacccagctaattgtttgtatttttagtagagacggggtttcatcatgttggccaggttagtcttgaactcctgacctcaggtgatccacccgccttggcctcccaaagtgcagggattactggtgtgagccactgtgcctggcccatatcttcaattttaaacatggagtgcttcatggtcagtcttcagatctcttttcttcattgtctacactcactttcatggagagatctcatcccatctcatggttttaaatacaatctaaacaccagtacatctcaaatttcactctccaccctctcccctcaattctagactcatatatccaattgtctacctgatattttcacttagatgcctaactaaattgatcatatccaaaactgaattcccaatctcccacctcacaaccttccagtataatatgttccttgtatagtcttcccctcttggtaaatgaaaaccagttgctcaggccaaaacctttgaaggtatctctgacccctctttctcccacactcaatactcaatctctctataagtcctgatagctctactgtcaaaatgtattcagaattttagcacctcttactggcccaactccctggtccaagtcatcatcttttgcctgcattattgcaatagttcctcctgcttcccagttaggttcccctgtttccactacacagtccatttgtaatacagtgtgattttttaaaaaatgaaagttggcttatatcacttctttactcaaaactctccagtggctccacttcttagagtaaaattcaaagtctttacagtggcctacaaggccctacatgaagtagttctggttacttaattgatttcatgtcctcattaaccttactcattccacttccatcacaatggctgccttactcttccttgaatgtgtcaggcttactcctgctgcagggcatttatacttgctcttccctttgcctggaatacccctcataccaccccccaccccccagatattcatatggcttactcttacctcctacagatctttatgcaaaagtcaccttctttcttggtgaggcctttcctgtccacccaatctgaaataaaaacctcttctgctccacccacttgatctcccttactttactagatttttctccatagaacttatcaccatttgaaattgtatacatcttcctcatcttcctccagtacaatataagttccataaaagtagggatttttatctgttttattcatagctatatccccagcgcctagaacattgtatggtatgtagtaggtgctcatgtgtttgttgaataaatacatgaatggttgaactggttcttttgaaaactagttaatacttcagccatctcttgctgggggactgaattccaccattagctttcaaaatagttgtttgcctaatttcagctgcagtgtgatccggcttgagtttttaaaaaagacattaaaacttctcattagaaattttatcttttctaagggtagtatatttaaaaacacaggctcttgctggttgaatcctgggtatttatgtgaatcaggacaagttaactattttgtccttcagttttctcatccataaagtgggcatacttaggggcacctatcccatgttattatggggatcaaataaagtcacatatgtaaattacctagcccagtacctggcacttagtaaatctttagctaaccgtagcttttattactcttattaagatggaagagaattactttcaaaaaacagaggaagacttgcaactgaaacaactgaatacatttttctaagtgaaaccaaaatagctgtctggctcttttgtacagatggcatttctttggaaaatgatccaaaacttgaaggccaattgttttgtccctttcttcaagaggctttcatgggactggacatattctctatatcctcccaaaatagtcacacttggaaccccttatactttaacatctccacttctcacattcttcaactttgatgccattccagactctgaattcagattccatggattagctcactcagtatactggtaaaaaactcagcaattccttttgtggggaaaatgcttcccgagtgccaaaagaccagctttctagatgggcttacttgcaaacaaggtcatccatgccttaaaaggcaaggacaatggtctctatttctgtgttacggcacctcctagtagcttgctgtcagacacattttgtgttagttccccattaaacaaagttatcacagttccagtctataaatgccaaaatgtgctggattattcaacttgtgcagggaccctgaggaagcccaatcccgtacagagcatttggctcttccttttacagaagcagccaatggaatggagcctctcctattcagcatttgccccacataattcttctcttgctttccagggtccacttcttatatttgaacttctctcttacctcccacagcaacttatactgagctgggctgggctgggcatacattcatttattcattcattaaaccccacagggctcaataaatagttgttaagtcacactgcttctttgctgctttagaactacagttttgttatttaaatgaaattgtaccttatcttcccagggatgttgtaaatttcttgagtacttgtacttctacctcattcctgtctcctgcagtgccacacttgagtcttccttgatgcagtctgtttttattattatgctctgcaaactgctctggaaaaatgggtctgaactctaggaattaggtaaaattttctccttgacttttcattttttaaaatggtggttgttaggagaaaacagcatgcaacactcagcaattactaaggcattttcccagtataatacaatttcaaataaaaacctaacaaagcccatgtcaagaattagaaacttactcataaacggttgtccatccattttcgttacttttggtagccagaagccctgtgtttcctggataggtcattaaggccagattatagccttgggctgacactcttttcaggactccattgctgcttatagtcagccagtatacttgtccgccaggcaccacaagccatagcggcattccgcctgcatcacggcgaatgtgcactgaattgccattgctgctggtaatcgcgcccaagtcaccttcagaattgtaggtgaagttataaacatagtcccttgttatcaagttcagggtgtgtaggtgggttccatttacagtgaactggtacagttcctgatcagcgggtgaagcaatctcataaatgttcatgtcattcaggtgggcttggttcctgctgatggtacgaattcgaacatttccgaggtctgccacatagagggttccatcaggcgacactgctaaggaggaaggggctttcatctttgcatctttggcatagccaccatcacctgtgggagaaagacttgattttaacaattggcatcataagcatttacatgaacataccacagacataaagctctgtgcatcaagaatcattttaaaggaaacaatcagtgaaccaacattctctgtattccctccctgaaaaatatgaagcctattattcaaaagattgtaattcttgagtcagtaccactgcagatgaacagtaagatctaattatctcagttataccaattttgtgaaatcctcaatcctgctgttcagaatctattgtattataagaaacaagaactgcaaataatgatagccacacaaaatttggctggaaatctgagagttatgcctgtcaatgctttcaggatctgtttcaggactttccagtcctactgtgcctagatgccctttcttctgttaattcccattgtcacactgtcaaagtacactaagtctataagtacaacaatgattcagaacatcaaatttgatacctggaataaacattagatttgctttgaccgaaagatacaaattagcaaaatatctataaaactaattgtcgaagaaaacattggaaatattgatcaaaagtcatattgaccaaattgctcactcctgactcctctggcctaaggaaaggcaaaggttaagagaaccattcgggcctggatgaacagtttaatagcactgcgtgtagtatggagggatttccacatcccagcaataattgtatctgttgacattaagaggaccgtttgccatctgagatatccactacatgttttggggagaaggctcttttttttttttttttccaatttcgattagaagaaaacttcactatgggttattgagaaagtcttagctttttaaaaagcaatgtatctagcagaccaatgtcctgagaactctccattgccagatttaattttgctcatctatcccaaagacagtctgttcttagtccctttgagtctcaaatagcacatgcttttaatctgaaaaccaaccacttatggggaagtaattttttcctcagctaaaccagtaaatgtgggttttacctagttttcctttctctaaagtacaaatatttaataatatcatgatctttcatttgtatagtggtctcaactttttaagagtctaaacatttttattacactagtttatcctcagaatagcaaggtgatataactgagacaatgccatctttattaaacaaatgaagcaaatgagtcatgaagagatcttgcagctttgctagggtcactcagtgagtcagttgtgagaacaagtcggtgatctgactcctaatccatcgctttctccactagctcataccaatgtttgcaagtaacactttgcttttccttttccttttgactttactggggcacgtttttcttttcaaaacagagaggggaagctggtgaattgctaaaaaggtcatacctgaaaaacagtcacagtttggatcaattttgcagtcacagtcagtgggggcaccagcgatgatgtagatctccccattggtggttacttgctgaatgcggtttactttcctctcgtctgtttcagctatgaagagcagcccgctgtgggagacactgatggccctcgctgactctagagtggagtgaattgctaccttgctgaccaggaaatgatcgatgcctggcacctggcagtgaatggggcgtcctgcgatgatccgaacacgcctgttctcagaaatttgcagcacaatgttgttatccaagacatacaatgaattgtccataggatttactgcaaggtctgttggccactctaatcgcacctgtgaaacgaacagaacacataccattaggttaccatgtctttccatggacagttttaacttgaaaaaaagaaaaaaaaattggtgtattgtttcccccgtcttatgaattttagcaacattggtgatgtctcggaaagtggagggcagggggaggatggttaatcacatgttctggtaaacgtacttatcatttatgccatttacaatataatgtaattttttccaataatttcagaaggatcatttagagtagaggttttcaaagtgtgttctctggatcagcagcaacagtattatctgggaacttgtgagaaatgcaaattctcaggtcccaccctagatctattgaatcagaaaccctggaggtggggacccaaacatctgtgttttgccaaggtgattctggggatcattgctgtaggaattccggtagctatgatactcaaatctctctcactgtcctgtagacgtataggagagcaaagtcatacaggtttctgggtgacagaatgccagagaagccagattttactcaatgagcaaccttttgcaacaggacctgctattagcatagacctagcatccactttgtggaacactcaggtacagttcgtcagctgttgatttagaatcctggggtgtagcacactgcttacttagcttgacctggttcactccataggttcccctttttagcaaagaaacaggttgtttttttctttcactgagtattcgctgagtacctttctctgggttaagccttgtgctaagctttgggggctcaaaaatgactacgacacggcctctgtcctcaaatgatttgtggtatagtagagccctcagaggaaccattagacaattactctccacgttatgaaaagaaggcaacagaggggataagatagcacttcacctggactaggagtcaggaggcaagatattcccagagcaggtggtacctaagtaaggtctgaaatgaacagtaggagaagaattgggtggaagttgaggggggaggggcatcagagttgaggaaaatctgggtactaggaaaagcatgggtgaaagtccagaggttaaagacagcatggcccatccaggttactaaaactaattcagtaagactaataataggctgggtgtgagggagacctgagggatgaggccaggtgttatggactaaattgtgtcctccccaacttcatatgttgaagccctaacccccagtgtgactgtatttgtagacagggccttcaaagaggtagtttagattacatgagatcataagggtggggatctaatccaacaggactgatgtctctccaataagaggaagagataccaggaatgcttacgcacagagggatgactatatgaggacacagctagaaagcagccacctgcaagccaaagagagacacctcagaagaaactaaactcaccaacaccttgatcttagatttctagcctccagaagtatgagaaaatacatttctgttgtttaagccattcagtctatagtattttgtatggctgccctagcagactaatatatcaggtgctctggtttgaatgtgtcccccaaatatcatgtgttggaaacttaatcctcaaattcatatgctgatggcatttggaggtggggccatatccatcacctcaagcatttatcatttctttgtgttaagaacgtttaaaatccactcttgcagctatttgaaaatatataacaaattgttgtttattatagtcactctataatgctctagaacactagaacttagtcttcctacttagtggtagttttatatccattaagcaacctctggctatccctgtccaccttcccaacctctagtaaccactattctactttctgcttttatgaggtcaacctttttagcttccatatatgagtgagaacatggggtatttatctttctgtgcctggcttatttcacttaacgtagtgtctgatatggtttggatctgtgttcctgcccaaatatcatgttcaattgtaatccccagtgttggaagtgggtcctggtggaaagtgactggatcatgggggtgaagttcttatgactgatttagtactgtccccccttggtactgtatagtgagttctcatgagacggggttgtttaaaagtgtgtagcaccttccccttctctctctcttcctcctgctctggccatgtgaggtgccagctccccttcaccttggctatgactgtaagtttcctgaggcctccctaaaagccaagcagatgccagaatcatgcttcttgtacagcctgtgaaaccgtgagccaatgaaacctcttttctttataaattacccagtctcaggtatttctttatagcagtgtaagaatggattaatacggtgtcctccaagctcatttatgttgccacaaatgacagaattttgttcttttttgttgctaagtagtactccacagtgtatatgtaccacattttctttatccattcatctgtcgatagacacttaggttgagttcatgtcttagctgttgcaaatagtgcagctatctctttgacatactgatttcctttacttttctgaatcataacagttctatttttaattttttgaggaaactccatattgttttccataatggctgtactaatttacattttcctttctctgcaactcaccagcatttttttttgtcattctgataacagccattccaactggggtgagatgatatctcattgtggttttgatttgcatttctctgtttgaaagataattaggattagataaggtcataagggtggggtccccatgatgggactggtggctttataagaagaggaagacagacttgagctggcatgtttttgtcctcttgccatatgatgccattccaccatgttatgatgcagcaaaaatgccctcaccagctgccagtgccatgctcttggacttcccagccttcagaaccaagagctaaataaatgtttttcttcataaattacccagtctgtgatattctgttatagcaacaaaaaacagactaaaacattgggtaatagagggaagcacatgtccagttttgttttgatggctgtgggaagccactgaagggctttaagtaggggtgtgagatagtcatatttgggttctagacagatcatcctggctgctgtccagaccatattagagaaggaggcgagataggagggaggcaggcatttagggggctcctgcacgggcccaagttagggattatggtgcctgaactgggatggcaacaatgggtatggagaaaagcagatggatttgagacatgttaaagagttggaagcaaaaggactggtgtgtgtgtgtgtgtgtgtgtgtgtgtgtgtgtgtgtgtgtgtgtgtgtttggtgtgccttgtgccaagagatgtgctaggcactggagacatgcaggctagccaaacatggcttcaccttagttcctttctagacacaggagttgattcaatgcctaccctgacatctccttgacagtaactatttatccctaggtgtttctcagggaactgtgttccacaccattccccaccctaccactcacttgttctctatttcttttcttttaggctaaaggcagaaaaaaagtcccattcatggccaaaatagtaacagtaatgtagccacttttcttttttgctttgagtgaaagcccacagaaggctttgtttttcttgtggaatctgaaagtctgaaaacaaggtatgagctgtcattgcattctgcggcctactacttccccagctcaaagaggcttacaagcaatcagtaatgaagtggataaaggtcaatttgagataaggcctttcttctaattgtgtctcattagggagggcaactggtgatattgtgaagaggacaaaggttgtctttgacctcctctactgcaccatgtggggctctttgcccatgtctgagtctctcccatacatccagcagcctcattctgtttctatgtttctgtgtgccttccacctctatccacatagactggccttctctggtcagtaccagatgcttctgtgcagctaggaatttgagtgctaatggggtataaagctgagcttgtgttatgcatgttctacagagcctttcagactgaggccatcggataaacattaaacaccagccttaacagctcccagagcagtttgcggtgatgtgttcctcagcacgtctgtctgaggcctttgcatgtcagtgccctgccactgagagggagagtgaacgcctgctgctttggagggcgctgactcctccactgtgtgcccctgccttggacctctatacactatcatgcttgtccagaagctgtctgtgtgcactggtcctacggagcatagtcccccaggaaatgagctggggctggctgaggaagaggaaatgaattcatttccgtacaacactcccattttgattgagtctcaagtcagtgacccagaaaaaacaaacctggcagaaatgacgttctaattatccccactctgggagccgaggccagggcagaggctggggacagcacacacctggcagaagccagagaagaagcatgtttcagattctgtttttagctatcaaggctgcctctgagataaaggctggtagttgggaaataagctgttaaattctccaactcacccaaccagatttaaaccaatacgattggtgtcatgtttattatatttaattttgcctcaaaaatacaccagctattttgtctgtttgttttcttttccatggaataagtcaccctccggcatcttcctgtgactaaagtgccctttctgcttctgagccattttctatacaaactacacagattccctttaattcccatttgatttggccgggcagcttgtctatgcaatctccacagatgaaagatgtgtggctacttagtagttgagagtctgccttttcagaagctggacctcttcacctctcgtagcttgtcagttccttttatgtccttctcatgttaaatactcctattgccaggtaagttttcaaggaactggtgccttatgctcacacaacagaaatactgtatttactaccaagacattttcataacatacagcttaatataaggaatggagtctttgagctgattctgacagttagaattagtatctactagttgcagagagaccctagaattatatgatactaaggtggggctaaggttggcccccaattgctgctaccatttgtccaaatgatttcttggggtaaataaacacttcttttttgggggggtgggaacagagattgaagagcagcagcaaagctctgtaaactctgcctagtgacccaacctacaggcaaactatttggcctcatttgtggtggttgccacaccttgtaaaaatacattaatttgtttgaaatgtcaaaatgcatttaagctaaactagcattaaaggtcacttgtgtagccgccagctggtggaatgtgcctatctcccaacaaccttccctgagaaataaccctgagcataaaggagctcttggtcaggatgtcaacctttgacagcattacgtcttcctctgctaattgaaaacttgccttgaagggagttgactctcaggtcaaccagtcccatgattggtttagagatccagctaattttgacctaagtagcaatttataaagcagcagaatcctatagggagaaattcatgtttaaaagcaatatctaaatataatcccttggttagactaaactggaaaatgtctaaattatgtataagcctaatcccatactgtatgctcaaaccaccatttgtatacttgggctccctccaacagtttgagtcctggttcccacccttattagtatgtaacccttggcaaatgaggtatattctacgagtctctggtttcctcatctgtaacaaaacaaggaggctagtgatagtatatctacttgtaaagttattgtgtggattaaatgagataatggtgtaagttgcttagcccagtgcctggcacatagtaagggatagcaagtggtattaatagtaataacagtttttatagtcatagacctttagagctaggaggaacctggcccagttaccattcaatgtagctccttttcaactgtgtttcccagacttcaattgtccctgtgccacctttatgagttttgcctcacccctacatcacctgcactattattgacttaatattttgctttaaattgacttctaaaatgtgaataggtgctgccccttcctttgaactgttatgtaatcaataacacatgaaattacaggcccagtcatctgagccattaatagaagtgactactgtttactgaatgcctgctgggtgtcaggtacttcatatggtttaccacttaatataaaaattacctgagaaaaactattaacatctccactctcagatatgtgcttttagcccctatgccatctgattcgtcattcccaagactggacatgtttcttcattcttgtctcaccaaatctggcctccccttatccccttttgaatcaacctaaaggtttctctctttggctgtgaaggtcaagactttttatgagttgagtgatttatctttttctttgtcatctattatctttcagttcaatgctttatgagttttgaccacgtgccaggcactatgttataaaggtaaacaaacagatttctgctcttgattagttcaaggcagatacagaaatagataatttaacataatgtggttaagtgtcatgagtgccatgatagatgtatgcccagaatgacatggaaacacaatggagggagtttggggcaagattcctagaagagaaatgtaaacttaattttgaaggatgaagcaaaggtattgagaaaaagcaaggcgggaagggtgatcttggcagagggaaaagaatgaacaaaagtacagaagcatgaaatcatatgagagtgaaggaactaactgctgtctgggatttcttaggcataaaataaggtaggtggtagtggtgaatgagttctaaatgtttgctaggactaggtccaggttcctccactgaggctctgttgtcaggtggtgccagtcctgtgcattgtaggatgttcagcagcatccctgacttttacacattaggtgccagtagcaccttacccccagttgtggcaactgaaaatacctccagacattgcaaaatgtcccttgaggggcaaaaatgtctcttgctgagaatcaccgcattaagtcatggagagtggtatatgctgatagctttagacttaaactgtgtgtgttgaggagtctccactttaaagtggagagctgacatgatcagattagtattttagaaagattacttaggctgcattttgggggacaggccggaaggagaccagactagatgcaggataaccaatttggaggacagccattcattggtacattcatcccttaatatatccttttatccaaccatctgacagatatctgggtcctgatccagatagacatagtccctgccttcatggaacttggagtctgggacactgcttctcatacttttttgatttactcatccatttgagaatctgatgaaagctatgtactctctccctagaaaaaggcttcaatgcactagaaggaagtagttaggacctcaggctcacgagttaagatttctggagttgaaaattccatctgtgtcatttgctatccctgtgaccttggcacgaatcagttaacctatctgagcttctgtttcctcatttacaaattgaatatagtaacactatcttttcaaaaattattattggaattagataggaaaaaatacatagaccatctagcacagtgcttggtacattaaaagagctttgtagaggctagctatttttgaaaattatggaacatgtgtgtatttgtgctggtccctgtctattgttctgttccttggctagttcataaactcttaagtttaatcatatagtcatgctttcaaggtttctcttgattctatgtcaccagtcatttcctccttgtttatctatgccattccttgagaatctttctaagctatatgtcctccaagaaatatttggctggtattgggatatattatctcatatatatctgtcagccaatttcatggctaatattttagcttattacttgaactccccactgttaattgtaatagtactcttggtacaattccagctacagaaaatgctaccttaattgatttcctttcttctgtcaataaatgtctatttatctcatgttaggtaccatgctaggcactaaggagccagcttcagtcaggatagactagattcctcccctcataatgtttatagtcttttgctgacttcatttccttcatcttccagtatgtacaaggggttgttagtggcatagagcagtagactatttctgttccagtttattcattttaagaagttaacatttatggaagtgctcaaaaacatatcatgactgttactatattttacaattgtcaccaagtgctaataatttcttttcccaaagttcaagtgtgctgaagaaaccagttgtttcccaaaaggtcctgcctccccatttcaaacatgacacttctaatctccctcttttactacactgggagccttgtggctcatttaaaaaatgactctgtttgattttgatctgtgagtcctcttcagtaggaatttccaggaagcgtatgattatctcttctgtagtatgccagccctggggaagatacagtgacaggactgagtgctctctgccaggtgttatgccagctccatgttagatttttccgcacttctaaaagctgacaactccagattgttagcatcactttttgtcagttttcaaatggtcttctcatttcttgacactgatactctctgagcttcttcaaatgtataaaagagggaaaaagccatctggagaaagtttggttttttgcacttggaaagcatgatgacacctttaagagtgatggcctttattgatcttgcttttaaaaagtggaaattattagaagatgaaatacaccaagattacatggccttgtcaacagggcaaattatttcccattatcttagatacacactcttgtgtctctctgcataatggctggagagtttgaagaacctctcaacctttggtcaaatgcattggcatggtctgtttccatggcttcccaattagagtaactgacacttaagttgcattgttcattgcaaatgaatagctaggatcaatctaatcaagagtaacaatttggctgatcttgagaattattctactgcagaggatatagattaaattgcatctctcccaatgttcctaaaacattttggaagtggggaaaacaaagcaaagcaaaaccaaaccaaacaaagcaaaacttccaaagtagtcctagtatatttcatcttctaataatttccactttttgcaagcaagatcaataagggccatcgctcttttaggtgtcatcatgttttctaactgtagaaaaccaagctttatctagatggattttctctcctatttataaatttgaagaagctcagacaatatcagggtcaaaacaaaatgttaaatttgtggttcctaaaattcctgtggcagagactgctggttctaggcctattcttatattcactctttcctcctgattacactcccagtttatttatttatttgtttgtttgtttgtttgtttgagacagagtcttgctctgtcgcccaggctggcgtgcagtggcatgatctcagctcactgcaacctctgcctcccaggttcaagcaattctactgcctaagcctcctgagtagctgggactacaggtatgcaccaccacaactagctatttttttatttttatttgtatttgtatttttagtagagatggggtttcgccatgttggccagactggtcttgaactcctgacctcaggtgatccacccacctcggcctcccaaagtgctaggattacaggcatgagccaccacacccagccaactctgtttttgaatctgagtacattgctgtttagaatacaagacattccagccttatttgcaattatctgtagtcaagtgaagttccaggcaataatatgtaagaggaagtgtggaagcacccacacttacaaatagatacttaaaaaggctgcttaaggagagctgacccaagtggaaggaagctcttcttgccctttcttccattctgcaatgtggatataccagtgagagttctagcagatgtcatggaccatgaggtggccttgaaaatggaatttatgtgttagagtggcaaggcaaaaatacagaaacctggaacccagatgacactgcggagctgccatctcagccctaaaccacacatctagcctggctgctctcttgcttacatcactgtcatgttagggttttctgttattcttggttgaatctaatcacggggaagacagtgctctgttaggctttggtcttgactggagttactcactacaacattacattcaaactggtctaacagatttctagttttacacctctggatgaatcacctatgattggaaaattaaattaaactaaattgaaataaattaagtctgaaagagactgatgcatgtagcaaagtccactagggcagtgttaaggggatgactaattgcttaaacctaatgattaacctcaagcattcttgaatacctagggctccatctttgggtacttcaagctcttccagctccatgactccttcatttagatccagtacttctctcttattctaaaatacttgtttgtcttcctatgttctctaccaagactatgagttttcgacggcaaagatgagaactcttttatttttgttttcctagtatctggcattaagctggcaaacgtttgttgaatgaaaatattagtgcttcattgacagtaatgtttttggtccatgaaagcatttaaaaaaattataacatgcaaataggctctaagaaaaactatttctcatcaacatgtttgtgtcagtaaatctgggtttccagagacccactgaggttagtgtaaattgccataaatacctcaattttaagaaatgcatttcccactgcctccatactttaacttttctgaagtgaagatgtatcttatagtcaatgtgtatgtttgatggtacatttctccccattacccaaagatatcgaattgatgttatgtcttatagtccatggtgtcttagaatttaggaaatatggtatttccattttggtctggggagtctgggaattcccaagtctctttcagaaagtctatgaggtcaaaactatttttcaaataatattatgtgcattttgtactttatcatgtgtgtacagtggggctttccagaggctacctcaggctagtgtatcttcagttttaaaaaaaatcacacttttattttctaataaggtaaatattcataggataaaaccaacaaaagaatagctcgttggggcccccaacaatttttagaaatgcaaatgggtcctgagaccaaaatgcttgagaatggttatcctagaggaaagaaacagtgaaagacaccactctattatataagggtttccttgaagctcattaagaaaaaagcatatattcctcctaagatagttcctggggccataagtcctgtccaaaagcatactgaaggagtggctgaaaatcttcacttcctctagagacccaatgcctgatgggtaccataaaagtttgttcttacaggctgcctcagaacaatcagcacgtacacactctctctgagtctgctgtgtaattgccactacctcatcttaataacaggcataattgctctgagtttccgtcgaccctttcttgcatctcctctctgaagcctcaattttggaaatggcacttgtgaatacacagaatgtttaaccacttccagttttcaatttacagtcaaagtcatctatcagcaggagatgaaggcccagtgtgaaaactacagaatgtccttcagactccacagctaatttgtttgtaaatttgattgttattgtaaggagaacatattgtacatgatgctacttacatgatgctacttgccgatttactgtttgtatctctgtttctcgggttttatcattacgctaaagaactgaaccctctcagcccttctgggggtgggaagaggaatatgaaaatgttactatgtttttttattttgagtctctattttaatttaattttacatgaattcattaaatatctactgtatatctagcactgtgggggatacacatacagaaggagaggcaatcagagtacacagttcaaggtaataagaaatcaaatttgaggctgcgtgatgagcccataaagtctgagataattcagagtaaggacaggacctctgctggtcttaacacagtaggaagtgagactcttgtcctcttgagatccaaggctttgcttgcataggagccagagacttataaagaagcccctgaaatcattctgcaatttgtttctgctgagaagttgcagaaacttgtctgttgcaggttgttaatattatagtattggcttgacaggacagaccaagcttccaattccctttggcacctaaagcaatttacaggccagaagtatgactgcacagcttttatgaaatggtctgatttcattgatcagccactctgagattatgttttcatttctgtagctactgctaacccttctttctgttataatatttcaggaagaaactattaaaaattttcaccatggagatgttaagctataagtgggctgggctctgaatgggaaggtaaacatcacaactcatgattgttctactcaaaagttcatttcaagttatactagaattccacagattgtctctctcatcttaactctgtaatgtttccaaatgatagggacactaataagagcagatggcctaatgaacatttagagggaagatttaactggtggtattttcattaggcctccagtgtgcttccgggttttgcccaccacttccctgtgtgtaatacaaaactgcactcactcaacagatggcccagctcaagcttcatgcttctagaactctggagatcggccacctgaccacttaccatgtgtacagaatcatttaaggaagcatgcgggctatagacttaagcctgaacaaaagcaaaaaatggtgatgaatagtgagtatctgagcttcaataaaaggggaggcaaaatcaccctcacgaatagcaaatctggctgaggtctcccaataacaggttcttacagattcagtaatgatgaaatcctctgtgacaaacagtccactctaattaatgtttcatctaaactgtaagcatatctgagtgactccagcagcaacaatgacatgaaaatctaacacctcattgcacagtgtgctagttattaagctactgtctcacagctcccaactcacccctttaaagatgctgctttgtgatgctggggttgggactcggcaatctacatttttcttttgccagctagatttctgataggtcctgacgatacagaaaataaagagattctgagaagctaaaggagggagaagggacttgatccttcctgcttgctttctgttcctgtcagtgtcatctcaacagtagcccttcatcctggaagcagtacctgactgcacttccagctcctctccctaccctgagaatcagtctcattatgctgcctcagaggcaccagaagcaaccagctggcatcttcttttttttttttttgagactgagtctcactctgtcgcccaggctggagtgcagtggcatgatcccagctcactgcaagctccgcttcccaggttcatgccattctcctgcctcagcctcctgagtagctgggactacaggcacccgccacctcgcccagctaattttttgtatttttagtagagatggggctagctggcatcttcttctcagaggactaggtcctacctccatggagcaaattctccaactttctaggttctgacaaccccaacctcttccctttgtttccccagtcggagagatggtggccacttcctacagatattatctctatctcttgtttttttctgaccctgtaacatctgtacatcacattctctatattaaatcctctctgttaaaataacgaatgtactttctgtttttctgactgcatcttttttttttttttttttttttgagactgagtcttgctctatcccccaggctggagtgcagtggcatgatttcggctcactgcaacctacgcctcctgggttcaagcaattcttgtgcctcagcctcccaagtagctggaattacaggcacccaccatgctcggctaattttttttttttttttttttttttttttgtagagacggggttttgccatgttggccaggttggtcttgaactcctgacctcaaatgatctgcccgccttggcctcccaaagtgctgggattacaggcatgagccactgcgcccagcctctgactgcatcttgactaacattcacaacattaacccacatacaaggatagaggaacagcaatacactattgtaggtcagtggtaacagaaaactagtaaaggtgaactggaagcagcaaggactattttggccccagagactttgctatgaaagtccagaaatccactgtgcttggatgttataaagttggttgtgaatgattttatccagagcttctctgactctggaaatgccatgtttatgtcattattctctagaaacttctcattcttgcaatttttgagaatgatttcatggtcgatcatgtgactctcccatgttattcggagacacaattctgtaccaaatggttcatgaagttgccccgtgacaacatttcctatgtgctcaattgttaacagtaatacattagatatttactattaaatttcttttatattcactcttgctagttttcttgtcagacattgcaattactccttcagaatcctcttctcattgatttggagttggaagtgtgttttgagatgcgccaaatgaacccctgctctttgttatgtatctcaagataaacacgtttcaacaggtgtagcctgttggtaacattttatatgtccccatgtttacttttccaaacacaccaacttttgcatgaaaagatggcactcttgctgacagccaaataactttctctttgagttgtatttccatttgataaagaggggttggcactgattcgtgcactttcccctctcataattaatagagagtgggagtaggtttaaaggtacagtgtagtctgaaatttagttaggccaactggcttgcattgggactcagcacaggatgttatccctagaacctgaagacactaaccactgaatttacttctagaactcctggcatcaggtgatctgcttgcctcggcctcccaaagtggtgggattacaggcttgagccactgtgcctggcctctgactgaatcttgactagtattcacaacatcaacccacatacaaggatagaggaacagcaatacactatcgtaggtcttctgtatcttagagagatacagaagtatcttagatatttctgtatcttagagagatacagaagtatcttagatatttctgtatcttagagagcttcaggttcacctcaggtcatggcacctgctgagcaaaatgtgtggaagactgagtggttcaaaagcaggtttgcaagccttgcatcttgtgacttgccctgaactttgaagatgcttttcctctggtgcttaatagttttaataagagctaacgtgccattgtcctttgtgtggaaagaggacactgctgagggagttttatttatgtgataaattatgtttttgatatagcattgagcacggtacttgacttttattttaaggcccctgacaactttggctatttgcttgtgtgcagacatttcagcagaatttggatatgctggagctgaggatgttggcctgctgttctctacttatataaacaacctgagctgtcactttggagggagcaatggaaatatctctgataacaggttattatattgtgattttacctaagagatgcaggcctgaaaaacagttaaaaaaaggtttaaataaatttggagaaaggatacaatatttaaatgaactctgcggatagtctcattgcattgtttctcccagtttatcattttgttaaatttggttttttttatatatataatagacttaagaaaactgatagatgtgttggaaacttgaatatcttgataaaaacagaagtcattagttagatgaaaaaattcatagaccaaacttgcttcaaaaatcctaggatgctgctttcttcttatgatatatcagcttctttccttttgacttcccacttagctgggagcctttttgttttgtcttgggaaagtcatattcttcatagtgacctagataaactctgtcttctttcttatgtactctaatatttatttttttgtgtgtgtgaaattgacccacctagaatggctgcaggccacccactgaatgagctgcttttttacttcttgatttcaaagagatagaggatgatctaacatcttacattcacagatgtataaaactcatactacattccagcctcagctccatagtcatcacaacagtatgtgaaagtagaaagaagatgaagtatttggggcaccattcaatgactatagtgaacattcattaagtgatctagacagagcttcacatcagcactagggagacaaaacattctgggaaggtcacagcaggttaagaccagtctctggaacatgtttgctacagcccatcacactcacctacagacagatatatgcctctctgtaaaaggtacacctatgtgaaaaggacagaaaggaagattatataatttctctatcagttctaaacttcttggtcccttttagttttgtaagctatcagttcaattctcttttgtgagcagaaggtcaaatactactactactactattactagtaatagtaataataataatgataaaataataatctattgaacgcttatgagccaaacactttgctaagtgatttatgcatattaccacattaaattctcacaacctccctatggggaaagtaacattatcacccccatttacagatacagaattttttcccaggggcacacacctagcaagtggtggatctaggatttaaacccaggcagtctgtattcccataccattaagctttactgactttatatattggtataattatgaagaacagtctaccctaaaggcctgattttgtctcttgcatcctctattaaaggattagagaaaggtttggctctcctttgccgttccagaaggtgtttttctgcatttgacagagccaggagactaggtctgggttgcataagcaataaataacattaagcaaaaatgcatttaaattagagactgacaactacagatattcaaaatcagaaaaaccaccttgcagacttacttggttcttgtgtcctcccattttagcaagtgtatgatgaatcaacagaaaatacttcatgaagatgccaattaacatcttacatcatctcttttatttgtaaagcccttcacacttttccaagtgctttcacattaaaaaagagaggccacttaatcaacaattgggtcatttatttaattagccttcataaggaggaataattaaccagctccaaaattctagtgtcagtttttacatctagtactgaatccaaaattatacagaaccttcatttgggtcaagaaatagaaaaaaatgatttaacatttttttctgtattaccatctttcagaggagagcagaataaatgatacagaacgaaatgttatttttctaaaatatagacccggtaactacaaatagtgtttatttagcattattatgtaattttcagccataaactctaatggatctctcatttacaggtgagtaataatgtggagagccactagggactctgaaaaaagcctttttaaatggcttttggtgctgttgtcaaatcagagtctaaacaactcttcctgccatctcatgctctgtgacagcataatttgattgctatgtagactgaagtttgtgccactttccttccacatgcctacctaactgacatggcaaacgtacacataaaagccaaggttacatgtaatgccatatggtctcttttttcacttctgatcggctccaacaatttatagttgcaagtgcctttcaaaaaagaaacttccttcatgtgtgttttctcatttaactgacatgacctccttaggagacattacatgtttttatcccactttttattggtggagaaactcaggctcagagatcttaattaacttgtctgaggtctcactgcaaataaatggcagaatatggactcacacccaggattgtctatactccttctactagaacactcttagtcaaaggaaaataggtgaattaggcaactgtccagagaagtttggtaaaacatgcctctgtactcctgaagaaatatgaataattgttccaggcttataaacatgtctggtagaaagtttgctcatttttattcagtagtcatcactttctgatttaaatactttcacatttaaggtaattgacatattgaggtctttgagaagagtgtggctaagttaacaatgccttcctgctatggttgatgtagattgagctccctctttatcttgtaggaactaacaagcactcccatttctgcacttataatataagcctttggatcagcgggaggaattggctgtgactcgtggtttgactgagtgcatgtggctcaaatgaatagaacaaaacattgctgatttaggatgcttatgtttggactcctgcaatagcccattgctgagcagttaaaattgctgctctattgttgtggtccaggcatgagaacggtgaaagaaaatgggaaaatacactggaggtttggttggtatggcttttaatgccatctaatctattagttgatagttactatgaaaatagttaattcaattggttaaactaaccatgaccaattaggatagagtaaatgtttggcataagggccaccaaatgacatttttcgttccattctactactccctgggcctcattaatttgctgtttgatcttctgtccactctctaatcttctcttatcctttcttcacctctctttttttcccacctatttgtgcctactgcacactggtattactgacccttgagaaatgtgttttcaaatatttcagatatatagctttcatcgtccctgtcttgctgtctacctgtaactcactctttccttctaccacatgcccttgtgtctgaattatctggagtgtggccagagaccttttctttgctttgacagtgagataagttccatagtcatggaaacattgagagggtgtggtggggtggaggtggtgagattttcatctttggtggcaagaacttttaaaataaactttcttttctttttcccctgggagatccctttattcaagcaaacttattataattcagattttcttgattccctacagagcttcacaaaactcacaagtctgtccctgcagggaatttcatttatagtggccttcatttgaaagatctaattctgttctctttcagtgtgcacatgggagactgatggaagtgcacaaagaaaagcaagtaatccatgaagaagttgagtttcaatatcatctgtatcagtatcactcaggatgatgaaggacattctgtagacatgaaagggttggcaagggagagagggaaagacaatgacagatgttaggcaagagtttaagaaggggaaaagaaggtgccttttctgttaaagaaaatttttttttgagacattgtttcactctgtcatccaggctggagtgcagtggcacaatcacagcccactgcagccttgtcccctgggttaaggtgatcctcccaacttagcctcccgtgtagctgggactacaggcatgcaccaccatgcccgactaatgtttgtattttttgtagagacgggggtttcgtcctgttgcccaggttggtcttgaactcctgaggctcaagtgatctgcccacctcagcctctgaaagtgttgggattacaggcataagccaccatgcctagccctcttctgctttaaaactactgtttttttttttcttttttttccacccagattgctgtaacttttcatgcctggatgactatgtgtgtgtgtgtgtgtgtgtgtgtgtgtgtgtgtgtgtgtgtgtgtgtgtgtgtgtgtgtgtatttaaaacaacagaaaatgctgaacccacttgtataaaattaaattgacatatagattttgaagaggaggctgcatattaccccttctacagagctgtgttattttatctgaagcttgcaaaaaaatctaaggacaagagaaagttgttttttcagttatgtagagagcagaagacaaccaaggaaggcagaggtctgctgcttggggcaggtggtatagtactgatggatgagagagaggggaaggttttgttttctctgttaaggagaatgacgacagagaatattgattcagagttaccaaagccaaaaatggatgaagggattgtaaaagagcatctaaattctttaactgagttcaagttttctagctaggaagaatcactccttatagagaacatgcaaatggggtttagaacttttttgtgtaattattgagaaatagtgggcaccagaagattagagatggttaaatatagttctgacttcaagaagaatcagaaatgtgccccacaacctgcatggagggagctttatgttgatttggaaaagatcttcaattgtattatgaaacagttgtttttttagctcttagatgaggaaatgatgtttacagacactgtgactagaaacaaattttttcaagtggttcttatttccttttaaacagagttaccaacctggtaaggtttctcatgacacctttacagataagttgggggaaatatcagtgaagagagtggctttcaaacttgttttgactgtgacactcactaaaaactgtattttacaccattatccagttgaaataaaaatattatgaaacactactcaccctcattacacatgatacaccttgatttttaaaattgtgtttcacctttttaaaaagctggtcataggccattatattgatttcccaatgtattatgaagaatcacaatgagtaggtgagagttcaaacacatgggttcataatctaacagataactagtctattggtgccacaattgcacctacctatccatcaattttataatggatgaaggcatagaaggcattcatcagatacataggcgacacaaggctgggaaggatagtgaaaatattagatgatatcagaagagtataaagaattggactaactcaaacaacatggaattgaatagagactaaggcaggacccagcagtatgttgtaaatcactaatggtgcaagtgtaagatgaggagatgggaatgagagacacgtgaatttttagttttctgtaattacatcacatcatatgtcaaatgtgtgatacagctgtgaaaaaatcccggtcaactttagctgtggttctttaatctgtgccctttatttctttagcattttgcaaaagtgcctttgaggtcaccatgcaagctaccatcacacggaagtaagcttgaataaagaaggttctgggacaccacctcttgtttgaatctgctgtttgcatctattttataaattgagactgatttgtttgaagtaaatgttctgtggctaaagttttttttttttaaacaatcaatgggcaaaaggaaaagaaacaatatagaaagggagttgtgacagttcccattctacctctgagtactcagagcacatctggattattttattcattctggaagccatggtggcttccattctggaagaatggtgaaggaactcaaaaccatgtaaaatgaagtatagttaaatgaagtgggaatgtgacttaagaggcatgaaagagttgttttcttgtactaagagggctgtcacgtggaggaggcagtttaatgtaatttggtgaaaataatgtgggctttggcgtcaggttgaccaggttcaaattccaactcagccacttattggttgtgcggccttaaccaagttactcaattcctctgaatcttgtttttcatatgtattaaaaacaggggaacataatacctatcttgaaggattgtcatgaggattaaataagataacatatataaacgtacccagtattgtgcttgattcactagtagattgatctcatagaatatagattaaatttataattcaagaaagcctgaacagttgcagtaagactggatggtgaaagttaaaggaagacaaaaagtcaaagggatccaagaagagcttgtcatcagtcagaggtattcaaagatggaatgtgctgcctgggggaggtagtactaattccctaacacaggaagcatttgaaaataggttggattgttactacatggtcagaatattctggagaggagtcaagcatcaaataactgagaagagtaagattcctagtggactagttcaatagatgtaatatatgaggacaaagtttgctcctccaaagaatgttaccttccttcctgcacaactatggatgatgcttcccctacccgtgttagacccatctgacaaatgggtgctgttggaaaccagtgggaaacacacaaatcatccaataagcacttatgaagccctggctgtgtatctggatgctctagacaaacacctcaaagtgtgtaccttatgggcagtaggtcaacaggatttcctatgcatgcaaaaggtccatcttgcttgtgtatctcctattgggctgactttgggaaaagcattaggctggctccaaggagtaacttgctatcccatcaagaaacttgctctaactcccaattccattctagtcaggcatcagatggaagtgagttaccagagcaggatgattcaaaagcagcaacagaaataaagcacccagtgtcttgataatcaactcatctcctgaagtgaaaggcctggttgcttatagcagtgcttacaaagggcagttatgcttcagagtttatactgagagttcagtttcagatttcagtaaatcaaaaaaagatattgattttgaacaaatggatgattttattgtcaaagcaaatttcatttcttgagatgattagattttattaaactctttcctaactgccactaaacacacattctgtgaataaacagcatattcttcaaccaagcggcatttgtcactcagctaaatacaatgctatttggccatctccagaggttggaaaaatgcacacttgggttcagaaagcttgtgccaaaatcttagttatatcactcaataactctatggtcatagcacaatatataatccctccgactaacagttttctcctctggcagatggggataataatatctacctctcaagggtggttgcattgtgtagacaaaatagaatagtgtaaattagattcttagcatagttcctggtacatagtgagctctctataagtggtagcagttattcttagacttactataggacttaatgatctgctaaagattaggacaagccctgagaactgattcttctttgggcttaggtttgccacagaaaagtacagaagatgaaggcaagtaagatgaagaggaccattctctcatatcactttctaacctccataggtactatgctagtatacatgggcctttctttgttggagatcttttggttttgaaatgctggaatgctggaaaggtaacaagaaactttagaaatttggttgtatttctgtggagacacctttgtggagttggaaggaaccttgagaaaacagttggtccattttcctggctccagagaggcctgtatgtcaagcattcatagattattgctatccaatatttgcttgaaaagtttcaaaaggtgggaactccacaaaaaatttttaaaaatatatgatgctgccatgtagtgttagaaacagtaagcttttcttaaggtctgattcaaatcttcatgttgcagcataggcctctattttctctcctgtccattcctgtcagcagaaacaatgcactctcatttagacatttgtctgtgccctcacccgtcaatatattttgatttactgaaatatgaaactcagcactgtgtaagctcagctggatcactgtaagtactactataaacaactggggctttgctcttggtgggtgttatgaagctccctgctcagctttcttctctctagctgaagatggcccatgttcttaagtacagtcatgggaaacatcggttgccaatctgtcacagttgtctaaacagatgggaagctctggtcataatggctgagcatctaggaagctgtgccacacacaggctttctcctggtaaactctctatcaactgacccatcaatttcattcggtgttctccagctttagtccacctgtgccacatctgggtgctgatctgcccacacctgagagctgatttgcttcaatgccaaagcctcttcttcccagccaaacatctcaaagaagtgatctattttccgtttctccatttcctcacttcctactctgccgctggtatctgactctcattaattagcactctatcaaaggtactcttatcagaggcgttaatgctgtgaaatctaatggcttctttaaaaagcacctcattttttatgatccctaagcagcatttgatactgaccattcccttcctcttgaaaaacttgcgtctcttggcttttttgacaccttcatggttttccacctaattgccaggtctccttctctcagcctcctttgtgggttctcattcctccgttttttcttgaatactggtgttccatagagtttggtcttgagccttctcctcttttttatgctgtgtaccctccgtgagagagctcatccactcccctatttaccattgccatgtgtaaactaatagcaatcacaactctaatctgtagttagacctcaagctttaaacctgtatccaatttcctgccagatatctttatctggatgccacacaggcacctcaacgtaccccaaactgaacccatcatccaaccatcaagcaaacctgcttctcttcctcttgtattccctgtaccagtgaatggtactaccatacacatgttccctcaattctgaaattgtcagtcaacaagttatttgatattggctccaatgtttaatgaatctatctacctttctatgagattttaggttcagccattaaaattgcttgcctatgtagcctgcataaagctgagcagtgtcatggaaagtctcatccagagttgtatcccaaagaaatatcagctgaacatcccaaaagcattggaaaacagcttaatttttatagcagtcccttggaaaggggctgatcatatctacattgatatgttttttccttgtcatacctggatttcttcaactgtctcttaagtggtctccctgcctctagtgttattttgcttcacttggttctccatgcaacagctagaatgatctctgaaaactgatttccatgcttaataccattttaaaaatgcatttcccttcttaacgctgttattatctcttcattgttcagtataacttcattatgcttataaggaaggcccttcaccatttcaccctcacttacctttctagcttcatctctcactactctttcatattctttttaccattatgtccttttggttcaggtatagatgttaactgtacctgctgagcccttcctatgcatgttccaggaacacacagtctactgtgggagacgggttggatacacagtttgccaacaaagatcaaattacatttaagcatggtgatactaaattccagtaagggattgaagcaacagtgaggactagaaccatcaaggaaggttcccatggaagaggtgaggtgtgaggaggatggagaatgggatttggaccagcagaggtacttccagactggggaaatggggccatgagaagtaggcctttaataaaggtagagggtgataatctggacactaatcaatacagtctccttgttttgagccagtctgggtggacaaattggatttactctttagtgtgtctcaggcacagaacaggaaatggtggatagcagcagagttactggccaaataatctggacataaaacctgctttctttcctggtaaatcctgctggcttctgccatccccttctcataccacacaacctcccctgcctccaaaaaaatctactgtatctctaaagctaaagttgtgtacagaaaggggaaagagggtacttcagagaaactgaggcttggaatgaaatgccatagagaaaagtttctgtctcctggttaccagggcttcttttcagtgggctgcattgtatttcccaacctgaaaaggatgaggtagattttatggtgggaattatgtttggaaagtgtcatgtgaaaaagaacccttctcatggtgatgatgatcatatgtttgctctactaagacaaataattctcttttcaacataacttttctacacagaaacagaaaagttgtttagagttgactgattgcaatactaaatgccctattttaagttaaaaatatcccacaagtgaatcatacatgtgcatcttctctgtccctcctcctccatacaaatacattcacacccttctttattgccataaataatgctccttttccttgccttctgcagcattttgaatcatggaaagttagactattctaggacttgatagcctgacccattcaagtctctattaaaaaagggtttgttcattttgtcagttttccaggcccaactccccatttcacttttgtagttgactatatatgaacatttcttgagtttctggggcagggcaggggcacatagagaagcagaaattcaaaacaggccagtgttttatagagttgtatgctcaaggtgggtggaggtggcaggagatcttagagtcaatgactaaagcaaggtttcttaggggtgtgttccttttacttactaatatggttttgctgtgtccccacccaaatctcatcttgaattgtaactcctacaattcccacaggtcgtgggagaaacctggtgggaggtgattgaattatgggggcgggtctttcctgagctgttctcgtgatagtgcatgagtctcacgagatctgatggttttaaaaatgggagttttccctggctaacacagtgaaaccccgtctctactaaaaatacaaaaaaattagccgggcgtgatggcgggtgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaatgggagtttccctgcacaagctctctgtttggctgctgccatccatgtaagacatgacttgcccctccttgccttctaccatgattgtgaggcctcccccaccatggagaactgtaagtccaataaacctctttcttttgtaagttgcacagtcttgggtatgtctttatcagcagcgtaaaaatggactaatatatttaccttgtttttctaggttttaggtggtatgacaaatgaagcaacaggaatatcataactgtggggtacactgctcattgcctccccagtagcaaccctttactccttgctaacagaactctgattttggtttaagaatcaggtagcaatgtgctcagggaaggggacccacttctaaagggtctgaattcactatggaatctcatttcccctttgccagtgactggtgaaggcatgggcatgtgactcaattctggccaatgtgacacaagaaggaaatttgctggcatctttgcctatctttggacaactcgttatgtgagataattaaactttattgtttaaacaacttttagacaagtattttattacttgcagacaagaccatcctctgtgatacactaatcaatttgaaaactctcaacatccactttagtgtttttgaaaagattatttaataatctactttattagggtcacaaatttatggaatgttagagctggaaggtttgaggactgtctaatctatttccttcatttcttgtttctgcagactaaaaaagtcagacactgaatgttgggactatgctgtatgctctataatctctttaaatgtctaatactgattttgtagaattgtggtaaaatcagaattttggacccagatgagagctacactgaattttcttttatcctcactggcctaaaaaaaaaaccaaaaaaacacagatttcctaaataacagtaaaatagatctcagaggggatgttgcttttacttaagaaaacttccaaacaccctagaaatagctatttatatacatgtgaataacaacatgctcatatattcattaaaaaagatgtctaaagagacttcgtagtcactatttttctaaatttcagtcactgtttcatttgactttcttcacagaattggataaaactactttaaagttcaaatggaaccaaaaaagagcccgcattgtcaagtcaatcctaagccaaaagaacaaagctggaggcatcacgctacctgacttcaaactatactacaaggcttcagtaaccaaaacagcatggtactggtactgaaacagagatatagaccaatggaacagaacagagccctcagaaataataccacacatctatagctatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaatgttagacctaaatccataaaaaccctacaagaaaacctaggcaataccattcaggacataggcatgggcaaggacttcatgtctaaaacacaaaaagcaatggcaacaaaagccaaaattgacaaatgggatctaattaaactaaagagcttctgcacagcaaaagaaactaccatcagagtgaacaggcaacctacaaaatgggagaaaatttttgctatctactcatctgacaaagggctaatatccagaatctacaaagaactcaaacaaatttacaagaaaaaacaaacaacccatcaacaagtgggcaaaggatatgaacagacacttctcaaaagaggacatttatgcagccaacagtcacatgaaaaaatgctcatcatcactggccatcagagaaatgcaaatcaaaatcacaatgagataccatctcacaccagttagaatggcgatcattacaaagtcaggacacaacaggtgctggagaggatgtggagaaataggaacacttttacaccgttggtgggactgtcaactggttcaaccagtgtggaagtcagtgtggtgattcctcagggatctagaactagaaatacgatttgacccagccatcccattactgggtatatacccaaagattataaatcatgctgctataaagacacatgcacacgtatgtttattgtggcactattcacaatagcaaagacctggaaccaacccaaatgtccaacaatgatagactggattaagaaaatgtggcacatatacaccatggaatactatgcagccataaaaatgagttcataccctttgtagggacatggatgaagctggaaaccatcattctcagcaaactatcgcaaggacaaaaaaccaaacatcgcatgttctcactcataggtgggaactgaacaatgagaacacttggacacaggaagggggacatcactcaccctgttgtggggtggggggaggggggagggataactttaggagatatacctaatgtaaatgacaagttaatgggtgcagcacaccaacatggcacatgtatacatatgtaactaacctgcacattgtgcacatgtaccctagaacttaaagtataataaaaaaaataataatagaattacttatcttggaaatattcaataaatgagattggccttaccctctgattaattcaagcttgagagactttacttaattgtatgtcaatattctacctgacattacttccatcctcgcttaccattttctcccaactaagcttttctaacgaggaaaaaagtaacttacataaagagaaacttctgctatctggtgttataacagatatgccaggcttccattctacctcatttctacatgagaaaattgttatccatttccatgatgccaaatgacaataatacttgaaaaccagtgatgcctacctgagtgatgtccattcctgagtcacagctcagtggttgtgtggaagtcagaccatttgagccgattacagttgtgatcacagcattctcatcaattttgcgaatcatagtcccatccacaaagtaaataaatccatgcctatcaactgtgatgcctgttgggaaagagcaaatgagcattagtagtctagtgaaccacatttgcactaagctctgtattttgaaaaaagccatagcaatggaaaggcattttaaagacatatagattcaattttgctcagcacagacaggacagtaatgggagaggtttgttggggcatacattcacttctttgtgtattgagaagaaatgacaaaaagtcacacgcggagataaagccaggtctaataattttgtccagttttacatttccacccccttgatacttgcttgcccccacaaacaataaaaaatcatctttaagataaatgggaaaagacggggagatcatgtatattacatttttttttagggtgctaatgcacaggctgctgcttattttcacgattgcattaggaaataactgacttgaaaagcattataattattttcatcaattcagactttgttaaaagggagtttgtaataactttgatgaaccgggctgagtttttttctccatattatctattaaaaggggagttggcgagcaaaattatagtatcacaaagggaatggctaagtttctagaaaagataaaagccgataaaattttcacagcagtttttacacacagtgttaattacagcctggtttcttaaaatttttattataatagcagttagaaggcttgggttctaatactgaataccccacttacaactaatgtgtgactctgattgagtcattcatttgcaaatttcagactcctctttggtaacatagggacaggatcgtctgccttacttagctaaagtgatctactgctctggtttggctgtaactgaggcagagctcagttttaaaactaggaccatccttgacaaaccaggatgagctggttactctatatctaggtatatctaggtgttttttttttttgtttttgagggagttttgctcttgttgtccaggctgggtacaatggtgcaatcttggctcactgcaacctccgcctcctgggttcaagtgattatcctgcttcagcctcccaaatagctaggattataggagcctgccagcacgcctggctagttttttgtatttttagtagagacagggtttcaccatgttggccaggctggtctcgaactgacctcaggtgatccacctgcctcggcctcccaaagtggtgggattacaggcgtgagatatcgggcctggccctaggtcgttatatcatatgaagtaatacatataaaaagtatcagatacactttaagaacatatggctctactcctatttcccttggtgcttttgacagtgctcttgaaaataaccacatggcatttttcaaactagtctacaatttagtcttttccccacttccctttatttaggtctggtgaaactcattgaatggatgttaaagtcagaatttctgtgctaacaagcgtgtccttttagcacaacacaacacacaaacacacacacacatgaattttctggcaaaatgtgaactcatctagagtcattttataaactcaacttaataaactgcttttagatgaactaattcattggcaggaagttaatattaagacttggctttatggtatactttgattaatcctgatgtttgattaatccttaacatctataaaagttacaaattcattttaatgtcccctgaatacttctaaagtcatctatgttttggtgagttctccaaggaaaccagcatgtccaaacaagggaattccatgtccataaatccctttataatttttagaggtataaggacccttaaggtggtttataaaaagacttttaagactggggcaagttaaatgatgatggcgtatgaacaattattttaatctccagaacattttggatgaggatgaaccaagggggaacttctgcctgttatttttgtgttttgcaacatcaatttcttgattgcttaaaatttggtgtggtttgtggcagacctattatttagaaccaccttctatgaccactatattaaatatcgctgagtataaaatttcaaatttggctgtcataaagggatagactgaaagatcaagactcaagactcaagtctggggatggaaagactgaaaggagatgtgctcgacatgtacgaaatcatgaatcatttactaaacactatgattactaaatcgtagtgaatgtcaccatgctaggctctgtgagggtataaggataaagaatctggttacactgaaactaagactaagaggaatactctggaactttagtaaattaaggatattaaaaataaaatgaagtgttgctcttatgaggaggtagtaaacttagaggatctgatcctctaaaaatttgagcaggttcacaaaaggtacagagaaataaatgtattcttaactagtatacatgggaaggtctttacatgtctttgctgatatcagggaggacaattcttttccttgactaccacacttctcatcccatcagagtgcaaagtttaggctgatccagggaggataatctgggactttacatagttttcttacttttactttttgtgaagatctaaacactgtgaacttctttgtctctgttcatgtcagctgagttccacagacgagtgccctttgaaataagtctgggcttattaaatactcactagttgccttcagggcttgttctgctgacagtttgtagaatattttcctttcatatatttgtgtagcaacttcttttatcatggtccaaattccaaacatacttctttttccttgagaagctttaattaactttgattgggttacacttatgtttggagttgaaaaagaaacagtagaaaaggctttgaggaaactatgtgataggtgcttcataaatgtaccgagcatattttatatgtacatattttcctctcatttgccttcccttaccaaccaatcaaccaaccaacacataaattccccaaacaacaattttgcaacctctttgctggtgaagcttaaggggtatttaattttcactgagggtaaaaatcaaattggaaaccccaggcatgaaaaagagaataatatttgtccatcatttggggaggtttcccctcccataatgcttattgttataacccagggatagtgatgatgctgtagatatattactgcttgtcagaatgagtgaaaggaggtgacacattcccagtatatattttaagctttattctttggagatgggcatgtgagtgatttcagatcacataaagccatctggggctagcaagatctgcagattcaatttactttccaattttgatattgctgtgcccagatctccaaaacttggtaaccaatgttgtgggcaaaatttgttccaacggtcatgttcattgatgtgttcactgacagcattttcattagcacttaaacaatcaaaggtacagtctctggatgagaaaagatttaaagatttaaactgtactaagaaaaccacttccaggtttaaaaattttcaaccggaattcatttttgttttcaaagcaagtaaaaatacagagatctctgatattaccacaaggttaggccgtgatgcaaggcaggtggaggtggaagtgggaagaaaacacacaatagcttgagtcccctcaatttaactttgaatttaaaaatccccctgcaccaaggaaaacactggcctcagatgcccagacagcatgtttagcttggagcacatttttacatttgggagaaaataaataaatccttgtaaattagtgcatataatgaaagcactgacagaccataacctggaagtgtgaatggtgctgtctccattcatcagcattaagccctaacaagctctttctatggagagacctgctcataaataaagtgcatcttgtaaaaaaattattcacaacatcccatgcaaagtaggggatattatataatatctgaactgcaggctcttttctctgtgaagcagtgctctgtatgaaacagctgcaaattataggcaaaattatttgacttcttcccttgtcttattatcctccaatgaataaatactttaattctttagatgacaattgcctaaagctggggcagcctggatagttacttataaatttatcacctgtgaggggaaaagatgctactgatcaatactgaaggaacaggggcatcctgatgtaatcactgagagtccagatgtggtgcttaatagcctggaaatagtagctaaatcccaaattagataacagtgaagatttgagtttttggctgtgtagaatgccaatttcaaatgttggcagaaggcatctctgtacttaattttttaaaattacagctgttgaggccacctacatttttattatttctatataaaaaatgaaacatctttcagaatataagctttggaaagcagtcataacattctcttcatctatagccctagcaacaagaaaactgaaatactggatgtttttctgccacaatctgctgtttaattttatcagacaaagataaatggttaaatcaacttccagggaaattcctaagcctaatatggtgtcagctcaatctccaatactgagagtgctgaattgtgtaactgattcaaaaatgttcttttagtcaaggagaatttttctttgttcatgtgcattccaattctctgaaaattggtactatatgtgtggtatatatggaaactctactaggcagaaaagtccattcttcaacccatctgactactgtccacttaattaccctctgggatcagaaaggcccaagttacttatgcataataagcctgttaagttttctcactatgtagccactaaatggagcttctagaacttggagggtttacagatttctgtgtgtcactagaggttggaaggaggcagagcttaatgacaagctgagatgatttcactgtgtggttaacagtggcatcaggatttctccagtaaggagacactaataaactcactgtaatattatatgactagtgaatagtgagttatttaatcagatattttgtttaataaaatgttctagtatattctacatagtaaaggtcaatttccaaagaacataaacacaaattaaaaatgataagctttcaaactaatattctgctgactggaatgtcttattttgattactcaaaaggcacttcaaagggcttcatagtcattataaagaacaataaatttgtgggctagttaaccaagaattctgattgagagaaagacagacgacaccagtgtttagcatttgtcttgtcttcagctccttgtgatcctctcaaaactttagacttcagctttgccataaggcaaagtgaatggacagcccttttaaatccaccaaccactatttttcttaaagcttactgagaaaaatgtttttctgtttactcattaacttattcaagatttattctgcaccctctgcgtgtgagcactgtcctaggcaatgagagtacaggagactataaaacagacatggcgttgctcttagaaagcctggaaactggtagagggagacagagaaataaccaggcaattgcaatgccattagataagcactagtttggggcaagtccaaggtgccatgggagcatccttgggggatgggccggggaaatgaaagtcacaagtgatttctcagacttaagtgataggtaagctgaaatctgaagaaccatgttgaattctagatgagcctagtatgtatgaaatccaggtaaacaccactgaaaatctatgaaagatgactaatattactaaacaataatcatttccatttgccgagaacactatgatattccaggtactgtgctggattccttacatagattttctcattcaatcctcccaacagccttgtggagtaggtactaatgtaattttttagatgaggaaatggaagtgcagagaggtagagtgactaactctaggttacatacctagaaagtgctagtttaaagcgatggggaaaggactccctattcagtaaatggtgctacaataactggctagccatatgcagaagactggaactggaccccttcgttataccatatacaaaaattaactcaagatggattaaagacttaaaagtaaaacccaaaactataaaaaccctggaagaaaacctaggcaataccattccagacataggcatgggcaaagatttcataatgaagacaccgaaagcaatgacaacaaaagcaaaaattgacaaatgaacttctgtacagcaaaagaaattatcaacagagtacacaggcaacctacagaatgggagaaaatttttgcaaagtatgaatctgacaaaggtctaatatccagcatctataaggaacttaaacaaatttacaagaaaagaaaaaaacaaacaaccccattaataagtgggcaaaggacatgaacaaacacttctcaaaagaagacatacatgtggccaacaagcatatgaaaaaaagctcaacattactcatcattagagaaatgcaaatcaaaaccacaatgagataccatttcacacaagtcagattggctattattaaaagtcaaaaaataacagatgctggcaaggttgtggagtaaaaggaatgcttatacactgttggtaggagtgtaaattagttcaaccattgtggaagacagtgtggtgattccttaaagacctaaagacagaaataccattggacccagcagtccccttactgggtatatactcaaaggaatataaatcattctattataaagacacatgcacgtgtatgttcattgcagcactgttcacagtagcaaagacatggaatcaacctaaatgcccatcactgatagactgtataaagaaaatgtggtacatatacaccatggaatactatgaatccataaaaaggaatgagatcatgtcctctgtagggacatggataaagctggaggtcattatccttagcaaactaatacaggaacagaaaaccaaataccacatgttctcacttataagtgggatctaaatgatgggaacacatagacacatagaggggaacaacacacactggggcctatcggatagtggagggtgggaggagggagaggatcagaaaaaacaactaatggatactaagcttaatacctgggtgatgaaataatctgcacaacaaacccctatgacatatgtttacctacgtaataaacctgtacatgtacccctgaacttaaagtagaagttgaaaaaaaaaaaaaagaaaatgctagtttaacacaagtttgtctgagtttaatgcccattctcttaaccactatgccatgtagcttaaatgaggttatcaattgctttaccacagggatggggtacagactggcttaagaaggttcagaaactccatgaaattatccacaaaatgttttgtgtatgggtattatcatggggagagagcccattggctttgttagattgtcaaaaggatctctgacccgtcccaaaaattgttaagaattcttgtattcctatagatctcttagacttcttcagaattattcttcaaaggtattctgtggcttcatcttcacagagctgatgagtttcaagaaagtactcaagaccttccatgtggtggggagttcagtaactttactattatcatagaattaccacctaaaaaggagaccccacgcagtgggatatcaactcacctaggtcaaaatagcttttattaaaaaagatagggaataatgaatgctggtgaggatgtggagaaaggggaatcctcatatattgttggtggaaatgtaaattaggatagccactacaaaaaatggaatgaaggtccctcaaaaaactaaaaatagaactatcatatgatctagcaattccactactactactgggtatatatagaaaataacggaaatcagtatatcaaagggatatctgcactcccgtgtttattgcagcactattcacaacagccaaaatatggaatcaactaagtacccatcaataggtgaatggataaagaaaatgtggcacatatacacaataggatattattcagccataaaaagaaggaaattttatcatttgcagcaacatggatggaactagaggttattatgttgagtgaaataagtcaagcacagaaacacaaatatcacatgttctcactgatacgtgggagctaaaaaagagagtagattagtcgttaccggaggctgggaagggtaagggaggatgaagagaggtatatttatacccattaatcaatgatagaagaaataagaactagggtttgataaatcagtagagtgatgtaggttacaataatccattgtatatttcaaaataactagaagagaataatttgaatgtttctagcataaagaaaagacaactatttaaggtgatgaatatcctaattatactgatttgatctttacaaattatacaaatgtatgaaattatcacacatagctcccaaatatatatatctatatgtatcaattaaaattaataaggtcgtttcattttcagtatgacagagacaatgctatgtgttcatgtcatcccgtttctctttctttctgagaacagagttagattacgtttctcagcctcctttccaagttaggtgtgggcagaagtaatggatgcgacttctaggcctgatccttaaggaactatctactgagtttctgtatggattactaccttccactgtaggctggctgcatgcagaccatccagtagaggactccaaggcctaaggcattgaggaatcactagatggaagaaggctggttccttgaatcactgcttggagcagagattcttccactccccaggcaacccacattaaattgtgatgtaagaatgaaataagttactatttttgttaagctattgagatactgtgtgtgtgtgtggggggggtgggggtgggggggagggtgtgtgtgtttaatatggttgttagcttggcccgagtattaacattcagcaacccaaatcctattcaccttttaaggcttttataggaagtttccctttcatgaatccttccctgcaaactccagttcattgtggtctgttttctaacccacagaagctgttacttatttatttatttgttaatgtgaattctccaatcatgatccatgtaggtaataagctccctgaggacaggaactggattttagaattagtttttatatctcaaataattcagtacacttgggcacaaatgttcaataaaccttcctgatttacaggactaaatttccatgcatttatactgaaacatatctaccttgaacaaaataaagcatgccaggaggccaagaactgcatatgaatttcactagaaatgagcttagaaaggatgcagtgacaatgtctttctctaaagtcctttaagaggaatacagtcccctatcaattagtgatgattggaatatgggaaaagtggggttgacaaccaagagcaaacagacaaaggaccatggatcaaattaactgcaaacaaatgtgatccatgtggatagctacaatgaatagctcatgacaccgctccccccaccacacacacaaatccagttgttctgtcaatataactttgtttgcgatcttgtgatctcttccgaccttaccatgttaggagttctgaagaaacagaagtgcctcaggattttttttcaggctgatttttcttacagaatagctgtagaactttggataatgcatttgaccgctcagtgtcttgatttcttaacttatatactacctactacacaaggtaacatggtgtgaagctcacaagagccaatgaaatgaaaggactttgaagaagataaagtattatggtggtgctaagtggtatcttaattgcctagttattgctataattctttctgacagtgacttttctaagcctagaatcatagtcaaaaatttccacacaggccctgcttgaacactttaggcttttctgtgttctgtaaataagatttaagtccatggagcattatgtaacccttgtcagtaggagagcaccctatgttagattcaccatagagacaattcagtagttgaaaacagttttgttagctcaggggaaatactacactattaaattattggtgtaaaagccttcaagcttttataagatggttaaagtttccgtacacagaatcaaataaatgaggttccatgccgtgcaactcgctaaggaagacccttggccaaggtggtggtaatgtctcaacatttaacagtgaaaccagacactgataataatgtgatttatttttctttgctttatagaggttggggtgtgtgtgtgtgtgtgtgtgtgtgtgtgtgtgtgtgtgtggagagagagagagagagattggggtaagtagatggtgctagttcaagttgaaatgcacatgtcttgttttatttttgtgttagagttcccactcaaaagatgcctgcaggctgagatttaagggttctcagtatatatgggctaagataaatgaggtttactaaatctgagctgcatattttatatctccccctttagaaattcctcaaacatcaagcaacgatatctgagacactactcagatacatttgaaagaactgtcgctgtcatcctaaggaaggcaactgccacacaagaacgttagtgaacaattagccctaggaaggaaagttcgtttattgcccatggaccagcaaaaaactaattgcagttgttgcactctagggaaaatgagtctatctcaaggtatgtgaatgaccaagaggttctaatataaaaagcaaactaagtataccttgtcccaaatactcaataaaagcaggatatgaggaattaagccaatagtgctcactattcacaaaagtggggtaactcaagaggaattaaaatttctttaggataatgatttgcatgtagtgcccattcaaaaacaacacagagggcccatttaaaattctccctgcatccgtatgtcttgactaatgaagctagtgctagaagagaagttcacaaagtcaggagtggtagacagtcatttgcaaaaggtaaggcagggtaatgagcactgcgtgaatacacattttaaaccttttaagtggaggttcaagagacgtttgggagaactgatttgggctcaatcaagaatatatgaatataacaacagcatacacacacagacacaggcacaaatatgacagcggaacaaaaagcgaaaaatagtcaaagcagttgtttaatgagataaacaacttcttttactgtttttacctttccacactctgacctacaagtgtgacaatctgtgggcacaagaacgcgacattgagaggcatttaaaatgctgggatgttttgttcaaagggggctggtgacttccttatccttgtcttgattgagattggagtttccaaggccatttccctgtctattttcctctaaactcaaatatccagacaagttcatcagagctatgagaggtggagtaaagagtctgggctagaagccagaagatccagttgtgagactgactgtgactttaacaaatttaaatagtctcccagtcctcaggttttgcctttgtctaatagtgagtagaaaagctgagctgctcatgtcagtggatgactgtaaagaccatataaaataacttctatgtgtgaaatctttctgaaagctcaacacaagtgatgttagtatttatttatgttttggttttattacttatttatagagacagggtgttgctctgtcgcccaggctggagtgcagtggcatgatcacaactcactgcagcctcgaactcctgggctcccgacatcattccccctcggcctctctaatagctgggaccacaggtgcataacaccacacctggcaaattaaaacaatttttttgtagatatgggggtctcactatgttgaccaggctggtcttgaactcctgggctcaagtgatcctcctatcttgacctcccaaatctttgggattacaggcctgagccaccgtgccccatcttagttatgccttattccttgatctcttatttcttttggagttcacttaacccatcaggaatagaggttagaatctagttcctagttcttttttacctttgtgtcccatcctttttcagattccttcctttttctccacttcttccctgttctcattttccccctttttttttctctccaaaccccaaccagctctccagtctgcgaatccccgtggtatttaaagttgatgcatgcaacctaattctgtattttagtcttttctaatgagtcctcccgtgtctccccaaagagataatattccactcaagggcagggaccatatcttcttagtttacttatgatttccaaatttgttgcttgaaaaacttaacaaaacaataaagctcagtgaatgtggttctttttctaacaagatataccaggcgcatgatgtggacgtgctacagtagctaaaaccagtgggaatcttatgaatagtaaggtggggccattgacactagtgtgttgttgacatcagtaaaataaatatatttaaagtattaattaatataatggcatctctggattcctgtcggataaccagtaagtttgtgctgcaacaagagatggttgtggtgtttgactatagcatttagcacagttcctgccatacaagactactttatatatataaacacactttatatgttcataaaatagatgattaaggtctattttagaaacataacaatttgagcaatttaaaaaatgagtaattaataacaggcagtgactctgataaaggaatgaaaacaaaacaaaactgagttgtatgaaaatacttccagacgccattgttacaactacagtgattcattccttaattcaacagctcaaacatctccagcatttccaggaactaggaagatatcattttagggccaaagcagaagcaagtggttttggtcatttgtaaattggctagtatttttttttaacattcaatacattatttgaataatgtcatactgttaaaattagatcagatatacttgggaaaaagtgcccagcattcgtaagaaaagtacaacggaaagaaacattttagggtgctaactgttgatctgtggtttctcaaaatttcaagtataacaagtgaaaatcagaagatttcaaagtaacccttcttctgtccactctccctggaaatgtccccagttttactactctgggaaaggtgagatcttgccccaattcattaaatagggctccagtagtagcctgcctgcagttctgattttactttgctcaagagaacacagagaaaggattatgaaaaccaatataggtaagcttagcagaatctattctgatggattttggcttgcggagggacaaagcagacctatcaatctattactatggcttcaatttcctcgggttagagatgctttccaaaatgagaaataattcctgcccactaagagaaattaccactgtagtcagcttcctttcctgagtaaatacaggtaaaatggggcacctacccaccttccttttcccccaaacccattagactgtttcccccaaatgcagtctaataagctttttgaaaattgtgttgcccctaaacacagtctaataagctttttgaaaaatcaaatggaatagctagtaaatgaaactggaagaaaaatagagcaaataacactggggcttcctggctaggctttgatatttgaggcttgaagataacctcacatttgagttattaagcctgtgattcctcagggggaaactttaaatgggccagaactcactcccaagggaacagtgactttcttcggtcaacgataaagctgactcattatacggaggctctctcaggaagttcactgtcagccatttaggaaactccacatatgggtacatactagaggtgctgaggtgatggtctctacagctaatggaagagcttcaaaaccaatctgttcagaaaataacggattaatgcaggggtccttgatgaacctgctccaaggccaaaactggtgtgtgttctcatatgttggtacctgtgcgttacaggatgttaaatattttgaccatcatttctataggagtgaaagtcttatttaaaacaaaacaaaacaaaacaaatcactttctgaaatggaatagtcaggcatacatttgtaagttgatttctaaaccctagttttgtttgtttgtttgtttgttttttgacagagtctcactctgtcacccaggctgcagtgcagtggcgcaatctcagctcaccacaacctctgtctcccaggttcgagtgattcttccgcctcagcctcccgagtagctaggattacaggcacacgccaccatgcccagctaatttttgtatttttagtagagatggggtttcactgtgttggccaggctggtctcgaactcctgacctcaagtgatccgcctgcctcagcctcccaaagtgctgatatttctaaaccctacttctgacttaaaatgtttcaaaattaggaaatatttcaactggttagaaaagtcagaaaataatattacagaccatcatgcatccaccaccaaaatttaatagatgttatcatttgcttcacatatctctttcttttttttttctttttgagatggagtctctctctgtcacccaggctggagtgcagtggcgtgatcttggctcactgcaacctccacctcccgggttcaagagattctcctgcctcagcctcttgagtagctgggattacaggcacccaccaccacgcctggctaattcctttttatttttagtagagatggggtttcatcatgttggccaggctggtctcgaactcctgaccttgtaatctgcccgcctcggcctcccaaagtgctgggattacaggcgtcagccaccgcgcccgcgcccggcacatatctatttcttaaaaaggaaatgatatggatatagccaatcccatctccttatccctatcctctttttccttccttctccagaggtaactactgtcctgaagttagtgtgtatcattcccatgcatgtttttataaattttccacatatgtgtatatatccatgaataatatatagtattgtttttgtgctttaaaaatttatgtaggagatggatgacagtgatggctaaacaataatgtgaacgtacttaatgcctcagaactgtatgtataataaaatagtaaatattgttatgtatattttaccacaataaaaacacgtaaattatattacaccttatgtatccttttgcaattttctcttttatccatgcaacattatatttttgactattaatggttttacatgtagatctagctcattcatttttactgttgtataaatgttccatcatttgaccaaccccctgtcaatggattattaggttgtttctattttttatactacagttaatatcatagcacatgtcttatgcatgtgtgtacttgtgactgtccatacactcttcttcagtcaagcaccctctagctcatctctctgatgttgcaatttttcccctttagttgaacaatgaattttccacgtaaacagaattaaattagggctgtgtctgtacaatcaatgaagtctgaaagaagaaaatttgaatgcagtcaaacaattttgaaaacaaaatgtttattacaaatcttgaaaataatctacttaataatagttattagcttaaaaaagtattttaatacttatcctctttctcatcatcatacttcattcagtacttattctgtgccaggcactgtttaacccatcttgcgtcatttcatcctctataaacccataatgaaggtaggtactatttccattttacagatgacaaaacagtggctcaaagatggattcaaaataaatttgagcccatttttatctgtactattccaaagtctctggttttaactactgcaaacacttcctaagttttccaaatttcacagggctcaaattggagaggcacatggtatgatttaagggtcactaaaaagtctgcccacctgccttaaatatattatatctttacgacaggaagattcttccagctggacacaaactctagagatgttaagaagatatattgataaatctgaccatatgaagttagaaaattctatagggttaaaaaaagagaaaaaaatgacaagcttggaaaaatatttggaacacatatgaaagacaaagggatgtttttcttaatttccagaacagaaaggacaacagctcagtagaaaaactggaaggggatatgaaagtgaatttaccaaaaaagaaatacaaatggtcacaacagatatgaaatgagactcaaattcattgataattaaaggaatggaaattaaagttacaagctacaagacaccatttcccactgctcagatgggcatacattaggaggtttatattgagagctgctgagggtattgcagactggcactctgatacactattagtgagactgtaaatgtgttcaatcttttgggaggacaatttggcaatatctactactgctaaaaattaaccctatgtatatactcacaaaagtgctccaaaatatatgaaccaggttattcattgcagcactgtaataataaaagattaaaaacaagcaacaagtatatcaagaggcaactggcttaatacattatggtgtatccatatgttataatatcgtgcagctcttaaaaacaaagaggtagaaatgtacctgcttttatggaaagatcttcaagacatattattaaataaaagaagcagggtgaggagtaatctatatggtatggtttccttttatgtaagggaaaaatatatatataggtctggaaggaatctcaaaagcctgttaaaattggttatctttacagagagagacctgggtgtgtttgtggcaaagaagcctgaaatttcttttgtatctttctatacagtttgaactatcaaaccatagacattttattacttttacatttttatgtttcaatgtcaagagtgcttatctagatgccttttaaatttttcttctttctcctactcttttttaaaaaaaataaatgtaatttaaatatcttttactactggcctgccaggattccttcaaggtcttccatttaggtttcttccttgacttacggtattgccccttcagcaggtctcctgtaacatgctcaggtgggagtaacccattgtcaaccatcagtactatgacactccttcttggagagctgtcatctatgaaaacagagagctgagtcctcagaaatcgggccataggacaagacagggtgtgtatgtgagaaaataacatacatgtatttttaagaaaaatacaaaagttgcactttatttcataactagacatcaactcaaaaaataatatctggtcttttgttgaattataataaatgctcagaaaattaaagagaagaaaagtcacttataattccttatgcccttatatagcaattatcattgctaacatttacatatactccctttcaaactttctctctctatatacatagagagaaatatataatatatagtaatatataatatatattatgtcatatataatatatagtactatataatatatattatataatatatagtactatatattataatatatagtactatatataatatataataatatatattataatatatagtactatatataatatatagtactatatattataatatatagtactatatattataatatatagtactatatataatatatattataatatatagtactatatattataatatatagtactatatataatatatattataatatatagtaatatattatatattatataatatatagtactatatataatactatatataatatataatatataatatatagtattatataatatataatatatagtaatatataatatataatatatagtaatatattatatataattatataatacatcataatatataatatataattatataatatagagtaatatataatatataatatagattaatatataatatataattatataatatacaatatagagtaatatataatatatacttatataatatataatatagaataatatgtaatatacaattatataatatacaatatagagtaatatataatatatacttatataatatacaatatagagtaatatataatatataatatatatattacccttacacccttacagatgaggcagcatacagtacatacagctttgtgtcctgaacttttcattgaatgctatcttgtgaatatcttccttatacctgcaggggcgtaccaaggtttgggggagcaggtgggagtggttggttctgggtatagagagtaaggggaagtgcattttctgttgaaatcttaaaaaacaataataaatctggtgaatagtaggtctgctttaactatcaacattcgctggaaattccaaataatgtcagtgataaaatacttcttccactgtcccatccccctttagtatgccacttatacccacccagttctgattagggaagagaggagacaaaaagttggatttctatctaggagagatagactgagggctgccgcaaggggctcagagttaggcagggagtcactgaaagatgggatgaagaggagacattttaaacatcccctattttctgcttagatctgtccagcttagataacttttaaacatatgcttgacgtaaaaaaaaaaaaaaaaaaaaaaaaaaagcggctgactatgaggtactcctgggtttttttttttttttcccaacaaaaaaacccagaagctgtctttatgttgcatataacttatgtcattaatgatgctgttgtaagtgccctgagtagtgacatctataaaccctgggctgaagtggccaaaaatggaatcaattgttcaattataaaataaaaaatgaacttctttactctatttccagctgtgttttagcctgtgacagtgttaaattcatagatttccaaagaaatcttagtttgctgcatgttgtttgaattttacactataaaactactaatttatccagtatttctggaggatccatgaagctaaaatgatcttttatgactctgctagtgtagagtgaatattctggattccctaggaagtcaacacactgtagacttcagattccttcaaaaatcagcaaagcatgctagtctcaccaggaaatgacttcccaatttctttaattttatagtcagctccatgcatttggtaatcgtgaaattactggaccatcttgtattgatggtggactaatatggagccatgatcaaagttcaactctaatacagctttatgttttagaatcttaaaaacaaacattttgcatggacagaagtgtcctaattaacttctgaagaatctgtacattaaaacatcttaccctgctggagaagactgataaagcaaacatactaccttttgctgaagagaaactgtatttagaaggaacttgctattctcataaaactttcaataggaagaagtgaatcaaatttcttaattaccattttatggttggtaaaagggcaaattacatgccatccatttctaaacttctaaatgtctctggtgcttttaattaaagctgccacctagaaactactaaagcaattttacacaattagttatttataggttaccataatacaccactcaaaatatgatttaagtgatttgcagcctattagtgtgtgatctctgtcacttttttggcaggggtggtgaggactcttctttttcatcagctgaggcagataagaaaagtgtgacattgaggagctgtgatagggaagcaaagttattttggctagcgatcttaaataaaaagaggaaccagaattccaagctgtcagtctttgcatgtaggcgtccaagtttcattctagacaatactgtggagatgaagtatatcagtgctattcctccacctcttcccactttgcagctattctgccatatacctagcaccacacttctgcatgctaccttcagtggttcccacctaggcttgtctttctcaggtgatcttgtcaatccaaacatatccatcttctgctccattccctccaggcccccattccctccaggcccccataaagtgttttaatgaagaattaatatgctgctctcctagacaattccctgcaccacatactaagtttgcatctgaagaaaatccttatgggaatgaatttaattgtgaaatagtacgctgctaagggaattactttagttagatgggccttgtggggctccccaaaatataacatgtacaaggaaccaacactagaattgctgcatctcaaggtgaggaggggtcggctagtcaaatcacatacaacatgtgaattccatcctaccttgactcttgcttcttctgtggcacccatcctacctagaaattatcaagtctcagattgacctacaaggacataatgtttccttccttccaaagtaacttattacatatatgggtcattattataattattatgactatagcaacaaaacagcaagactgagcataacagtaagtaatactgttatgtaatacagtaacatactttatgctgggtgtcacactaggcaatttacatacattatccaacaacccattgtgtaggcactattactagttttccaactttacagatgaggaatctgaagctcagggaagttaggtgacttgcctaaggttaaacatttaattagcagtggatctgggatttgcctccatttctgtttgactcaaaaacctgaaaaattatctaccatgttatctggcctctaaaatattacctctgtgcttgctagaatctgatgcatacatgaaaattaagacaaatgcagaagaaaaagtcatttaataatgcatctgtggctttataaaaattgaaaaaacttaatataggtcttccaaccatggatgctacctagaccaaacaggcaatgagccaaggctagatgtaagtgccttccttttgtctgacttctctcatcaacagcttatggctttgggattgcaacagaacaggccggaaggtcctcaagttccagttgctgacataatctaaggccaaaatcttttgactaccctaagcagatgcattagatgaactgtgcataaaaaacaggttaacctctaattctggttgtataacaggcactaactcttctgttgcagttacagtaagctgagagaccactaacagtgtttgagacagaaaccccccctaaatgaaaacagcacaaggtcattgagggataaacaacaaatattttgcctgaattttaaggctttatcaaacatgtttttttcaagatgtttctgattctaaaacaaggttgttggagtaaaattctcataagaaatgtcttgaaactgggctaggaatttggccatgggtggtagaatgctgtcttacccagaaggaagacttcagtaagtgcctctcctaaacctttcccacttacaccctcattttaagcagaacagatccacttctcagaacacggaggctatcaagatgaagaatcatcactcttctagcttctcctactacaaactgatcctcatccctataccctacaaataatcgcttcagtctcccctcctattctaggccgacttccttccagtttcctccatgctttgatttattccccgtcttctttatctttccattgactgataagcattgccacatctccccttatagaaaaaggcttcctgagttcattggcctcccacgatttatcactccatctctcacattcaagcttctcagaagagtgagcttcaccagtgatatttattttctcatctctcatgggctcatcaaatgactaaaatctggcttccacctctaccaccatccaaaccaccaatggcagggtcaccaacgaactcctcattgcctaatgcaatagctacaaatgtgtgacacttgatactgtttttcacacctccttgaaattaactactctctggcttcctggacagtgtgctcttttggtccaccacccttttttctgaaggtttctgctctgtttccttcattagatcctcttccattgccaatcttatacagatgagtactccctgtcatttatttgccccagttttgctccagcgcatttattaccctgtcgccaacattatcaaaaacgcatgcacaaggtgggcatctctcctgcttcaaatcctttccctataggataaaatccaaacttccttttcttgcttctgcccccctttcctattactctccaatattcttactctaagaatactgaattatttgcagtttcctaaatataccattctttttatccatgctatggcttacccgtaattttgttgagggctgtccccagtgtcaatctaaatggctttgttaccaagatggatcatatgctaaaggaatttaggaaaaaccataccacttccattgaacaggagaaccaaaagaacattctatgtctgtttctttactacactgtctccctcatagacaccagtgacatcagcaaaaagtcactgattatagccttagcatctttccattaaccccaaatataacttttcacaatagcatgcagatgccaggagaatgagtagggcttcaggatgtacttcagctagacctggatagggacaaaaacagattgtttgtgtctagactttgttattcccagatttcttaatttccaataaagttaagatgaatcccgtaaggttagtgtcatgtataccctaaaaacacttttggaagccgtcaagatttaaggatcatttccttcctatggaacagctcagaggctgtttgcacttgtctggatattgcctaagttctgctcctgctgagttctggcgtcagtttgcctgaagatgtacatgagaatagagatataacccttggtgaggtccaagagaaccaaattaagtcactgattaatttcatcctgtccagtcactccttcaccttccgtatctacttaaaaaaataaatgcatccagcttgtcacaaattttattttatatccccacctagtaccatttcacattctgcttaagtacttggtcatctattacatgactcattagtttcagttctctgtagaattaaagaaagttgcagtaaaaataataaatggaacctaagtttcaactacatcatccatgcatgttttaaaagcatctttcaaagtcaattcaaactcatatacaatgccagggattagtactccatcaacctcttttcgaaactttttttctttgtcccattacattgaagtattgatgagtaaaatggcaaatgtttctctttgttgagattcagatctaagtgcataaaactggatcagataaagacttcctcccaggagaagtacccagaggctatcacatgaaattctatttggggacgcttccatttttccttcaaacaaaatttgtagttactactgtagtcaagaaatttaataaaatgaagatttcctgcctgtgtcccttaaggaaaatttggtgaagtttctaattacagaatcttccaaagagaagtgacaaggtttcctggagatttatttgaataattacatttacagagtatgtaaacgctatctatgtagtgcactatgggtacactactaggtcagaaaaatctgagaaatggttttaataggaaaaggaaactagactaaaagttatttatcttgtaaataaaaatattttgttcccattgaatacatgtcctcagattgaaaagcatttttttcccccaatatttccaaccttcccagagatcatagattttagcagaaaggcagacagtgtggtatggtgaagtaaagtgtggccgaggtgggcggatcacgaggtcaggagttcgagaacagtctgaccaacatggtgaaaccccgtctctactaaaaatacaaaaatgagccaggcgtggtggccccttcctgtaatcccagctactcaggaggctgaggcaggagaatcgctggaactcgggaggtggaggttgcagtgacccatgatcgtgccactgcactccagccagggtgacagcgagacttcgtctcaaaaaaaaaaaaaaaaaaaaaaaatggcatcatgggtttttcggagtcaggcagacctggtttgaattccagtgttgttatctgtaaactgtgtgaaactgggtaaatttcttttttaaaaaataacttttattttaggttcagtggtacatgtgtagtatgtccaggtaaatttcttaacctgtctgattctctatttcctcttctgtacaatgtgactaatactatttacatcatgcattgttgtgaacatcagagaaactgtgtaaaatatctagcacagtgtatggcacacagtaggcactgaacaagttatagttacagttattttaatacattagagctgaaagggagatcatcctgaccccttcagtttacaactgaagaatttcaggacccagtgtttaaatgcccaatgtcataaaattagtcaatggcaccactcagcctgtctatcttcgtgttcgggtaaatgaaaccacagtgaggtacagtgacttgcacggagtcattgaaagaaaacatgggcattacatgtattgaaaaagaaagtccgggctccctcctttggtatttaccaaaacttgctgccattgctaaaaacaaaaacagaaacaaaaccaaaacaaaaaattcccatggctcctgacctgttacctttcgctgactggtttttaactccattggataatttactctgaatttagaatgaatgatctcaaaagcaaattttatttcatcctatttttagaacagatttagagagtaaattagctgtcgtacagattaacatttatttgacttaccttgcataattaaggacatgttggagaaccttcctataattgcaatatgttgcttgttaaagtcttggagcgagcaagctcttttccctaacctagaaatggtgctccctagatgtacatttccattttctactgatctacagcttttctttattagcttctaggtggagggaaaaatcaaacctctccttaaagaaattcattaaacgtttgctatctactaagtggaaggaagaaggagctgatgtacagggtagttttaaagcaaaaaacaaacaaattgggctttcttgagaaacaaagaatctgtaagagaacctcaaagatgaaatgagcaattagcaatactctcctctcattttgtacactgtaataactttttgcatgttttttccttttatggaagtctatgaaatcgccctgcagcatttcatttaaagagaatctcacttctaattcactgacaaaggtgagtgctgactatattcagcatggagataggtgccatagctaggcacctaagtgttctgaccagcattttcagagcaactgatggctggacagaggttctgccagctgagttattataaagatcactgacagggtcttcaaacattgttagcatggttgaaggagatgtggtggctacctagtgtgaaccacacatcccactcctttaagcattctagttcactcactggatcaaagcagatgttgacaacaccagcttcaggaacgttatgtgtaagctgtcccagatggattagacatttagctgtctgaagtctgggccagatgttatcagggctctcttattgctttggaatgaatgaagtgtaccagattatggcaaaggaagctctcggatagaaggatgagtaaatcaagacaaaggaaaatgtagtagtggctatgacaagaagaaaaacttagtttaatattagctttgatacataaatttcagcactctcattactgacgcttcaagagttcatgtaaatcctgttcatcagtactttattactgctgctttccaagaaaaaaaaaagctgcagtgaaccaattatttgctttatttggaaaagctaaaatattcattctctgtgtggcaggttgaatgcagtagttgaggtgaatggttttcagactagcagcaactcaggaggatgtcaatttaaggcacaatacaagcttgattcctctctattttttatgcagaaatctttataataccctcaagaattttaaacctgtgtaaaaggtgagacccagcctaatgtattttcttgaaagatgagctgatcacatgttgcacccgagttatttattcaatcattaaatacttattgtggacccactatgtataaggaaagagctggcacagagaaataaagaaaaaatttaccataatacttggggcggggcttgtgttcccttagggaaaataaatcaccccctgtaaacaccattgaaattccttttaggaattcctggcatagataagagttacttaattgatcaattacacaataagtatgtgtagtgggtcccacactatgctagaagttggtggggaagtggggaagattccataatattagatgtgatttcccatctcaagcgacttatttcagtagaaaaaatctcccattcatgaaagcactggaagcaaaagaaggcaaaataaaatcaagtgctaattgtgtagtgtagacactgttaaataaattcagatttaatggtatggggttagccagaggggctttataaaagacaaaggccttgaagaaagtgaaatctttaaactgtgatactagtaggaattcaatcccaatatagcaaacgtcaaatggttaaagagtaacctcttaaaatttaaagtaataagtgaccatctaataaattaaacacattgacctcactacatttattggcatggaaagatgttcataatacattgtgtaaaacaggttacagaacagcgttgtataatatgattctactgttacagaattaaaatatctgatatgcatggaaaagtctagaaggataaatactaaaatgtttacagtggttttctacatgtagtaggcttatgggtgattttaattaaatttttttattctcccttttctaatttttctgcaacaaatgtttgtattatttgtataataactaagaaaacactggctttgtaagcccagtaaaatgaataatttctaaaatcactaacataaatgcatacatgtatgcatgcatgcagatacacacacacacacatacacacacatacacaaacatcttagagaaggaactgagaagagcagttaaataattaagatgacagggtcaatgatatatgatgacagacttaaaagttgactatccttcaactttgtggcctaagattggcatatgatccagaaaatccagaagttaattgggagacacagatttgttcactagattctaggcaattaaattgaaggttggtctttgaagactgagaagtaaatttaggacaaataaaaataaggccaaactcccacagaaggcaacagaaaaaaattggaatttgttattctagaggcaatatcaactgaaaatataagtaatttccagaatgatttagataaattaatggaagaaaggttcattgaagattcataattttgttaagcaaaagtcaggaatgtttagggtctgtgagatattcaacatacttagcagtggtagaaggtaggcacagaccttatcgcaagcaatgcaggctgaagagccaaagcaggggtctgcaggctctctgctgggtcaggttaaccctttagttgctggactgtggggagtttccaggaggtaattctggggtgggttgtggtgccagggaggcactctgagggttctggctaatagttatttatcaactagaaaagaaagcatttcattcttttaataacagctataaccatactaatgaatattggctaaaaatgcattatgtgccttggatgtgtctactgggacagacttcaatattttggctctcagaggcaaaatattgagattagtggatgggctaaagtgtggcaacagtctcgggattttgtaaagtcaaataaaatctttagatgacccaagggtatatatatatatatatttatttatttattttttacctcgagggctattcagtgaagcttccgatgctctcccaccatctccacaatgactctggtcaaagggaaggcactgatcaccagttcctgccaccacttcaaaattcttggacagatctttcgtctccacaagagatttcaacttgtagactttgcgagtattggtgtctgatagatagagtgattcagacacagggtccatagccagatagtatttgtgagcaggacttgtgctaaggaagagaaaagtaaagttattcaaggcaatttttcaacacgaaccccctgggctcagccttttttcacaaatggaaaaatcttttgatagatgagtgaattcatttatcttccttcttaagtaccaaggagatggatacttctctgtttttctaatagtgggtctaggtatgaaacaaatctaatgtatactgctaattcataatgatgctgacattccgataccatccatttggggatagaaagaaacagaagacaggaaatctcaggaggtcatttttctcttattctccatactcagttatccaattacctactagatcactgctgggtgtctcagtcacctcaaactcaacatatccaaaacagaagttactttcttttcctgctttccccatccctcataaacctacttcctttctcttgggcttctcaccttgcttgtggacaataccatcctcccaggccccagttgtcaattgaaaggcatgtccaaagctcaaggagtgtcgctaagggaggatcatgctggagatctactgccaaacttctttccaagtttccctttttcaattgactaccacagttttctaatctggtttttgttctttcaggacataatggaactggttatatttaacctttttaaagttataatggcaatcatatgattgtgtaatcgcatagttatacctcctaaaagtgaccctaaagttaccttgtttggattctggcattcttgaaacttttctattacatactcacaaggaatctcaagttatttttatctgtatagatggctgagtttgtttattattttgattcttcctaattttagtttttcaatggctacaataaccttagttttggagacattttacttgaacctaaggtttgtgtaatactgacatcatccaaaccccaaatgtggaagtcatccctaatccctcttttgctctccacatgcaattgtgtctgtaaactaactttcagaaacattctcatcttccatccctatgccattacattagttctatctttcagtatctctggcctggaatattttctatagatcgatatgtaggatgtgtttttgaaatcttaaatcatttttttcccatgctgcctgcagagttattctgatcatttggctcccatctttaaaaactttttaatgtttcttggtgtgttagccaagcctttcttctcttaattcattcttacatgtcttttgaggctttatttgggcatcatctcctgaaggaagctttcccagtcttcccttctccagtctgggttatttgcattatcttacctctattctggggattacatatcatattaaattatttgtttatgcgttgtttgcatctccctctcctgccctgccagttgcaataaagcttggtggagagcaatcttgtcttgttcatctctgatatgttcattgcccatacctctgcctagcacccagttgtcaaagccagaaaccagaagccattcttttctacttccttctttccaccatttcccacatccagtgaaaggtggtttttaaattctactttctaaattgttttccagtctgctcacttctttttatctctgctgtttttactctaaggcctcatcatctctcatctgaactacttccttggtaccatttcagtattgtgtatttgtttactaattcattaaaaatcatttattaagtgcatacaatgtatccaagaactgtgctatgttctagagacctacttgtgtgcaagatacacacagcttctttctttatgaaactcacagtctagtgggagagacagataagtagacaggatatgactaccatgagtccaagtgttatgacaggagaaacagaaggagagaaattagtaaagaagagggacttgtgtcttagcagcacctattgtatggtattagcattatttttaaaacttattaaatgaagtccatacttattagatttccttagtttttacctaatgttctctttctgttccaggatcccatccacgataacaaattatatttagtcgtcatgtcttcttaggctcttctgtgctgtgacagtttctcagacttttcttgtttttgatgaccttaacagttttgaggagtactggtcaggtattttgcagaatacccttgactgaaatgtgtctgattgttttttcttacagttagacaggggtgataggcttttgggaggaagagcacagaggtaataaagtgccattctgatcaaattatatcaagggtacatactaccaacatgatgtacactaatgggtttgaccttgatctcctggctgaaatagtgttcgtcagatttcttcactgtaaagatactctttctcccctactttccacactttactctttggaaggaagtaactatgcgtagccaacacttaaggagtagagagttatgctccacctccttgagggtggagtatctacataaattatttggaattcttctaaatgggagctttatctcgtctccatctattattaattcaaccatttatttatatcagtatggactcatggatatttattttatactttgcattaaatccaatgctactttattttgttgctcaagttcttccagctttagccattgggagctcttttcgttgactcatgtgtccctttgccatatccccatcaatgagggattttttttttagcctttcctttctttctggcactaccagatgctctgggctcatctgctataccccctgccccaatcctagaatcagccatttctccaaagactcccctggttccctttattggagaatggtattagaaaccaagatctgggtgctgggtgtaagcactattttttttcctaacatatctttctctccaactacactgtgagctctttgcaggcaggaaccatattcatctctctattctcagtgccaacagagggcctgacaggattggtgcttagtacgtgctaaactaaactgaactgcaggatataaaactaagacataaaagagttcaggccttgctacttaggcaaaatggaggggagagggtggtgagaacaatcaagatacctttaaggactggaatgttattaattgtatttgtaattatatttgccctccaagcatatttatgtatgttaataataatcaggcctgcaaatactaatttgagactgtttatagttttaattggaaaaaattaggttcaattggaatacttaatcttttcctacttaccttcatcaagtaagagaatccagtagattccagggacacctccaaccctggaaccaccataacaggtgctgtaaataaactatgaagggccccaacaaactctagaattgatttggtagccataccagacaaggcatctctctgggaaaaactgcttcaataggggtttgagtaaaattctttacatatatagttaaatttttgccttcagaataaaatttttccaatgtgctcagatctttctagaaaaaagaaggggtcaaaacccttctttgaaacaactacaatattttgatagccagtttgtggagtttcaattcagtcagattagtcatgctttgtttaggaagagtccataggccatttttccaagagaaatgctattttgctatttgcacaaaagcactttggaatgcagtacattcattcattattgaatacccccagtgtgcctgtgaggaaagttagaattagcaatctcctcaaatctcagctggggaaacccagacacatagggagcttgtccggggtcactaacaagtttgggcctggaccaagattagactagattatatgtgattttgtgtgcaaaataccatcagaatactcttgctctgaaggcagcaaaacaaatcagcgttcctgctttctaatgagcaacatgtcctattttgctcagccaggctgttctcaaactttgtgtactggcccttagaaaatagaatagcccaacataccaaagtgaaatctaatcaatgttattttcttgatagccagcagtcaggaaggtccctcctatcaatatgtaacttgccatttcatgtcatttctcaagtgtactttagctcttttgaggctgatttctttctactttctgaaaacaagccacacctgagaaagaaaaaaaccactggactatattccaatttgctttaatcccttgtgtctcaatgcaaattgcaatttgagatatgtgaagatttcttttacaacttgggtgttaggtttactatcaccttttggttagttttacattcaagcaatgctcttcaacttagcaaagatcacttcattcatactagttaaaaatcacatagattgttaaatgggcaattaatgtttataattaatactgtgcaacattttaccagtaagctatttgacaaccaacttaatttgcttaaggaatcagttatgccaaagtagcaaggctgatcgtctgtactggcatttaggaagtggcattgcccaaatgaaatccagattagaaaccccatcagtgccattttgatgacaattggcattcgggagtgaacaaattcaattttctcctttgcaatttcaggcaatttagaacagttttgacaagtgtaatgcgtaaacacattgaatagaaatattcattatgattaatttcagagctatgtaccattgtctgcaaacggtcagtttaaggttttcctattatttctttttggtggaaagaaatagaaacagtgaggtcacataaaagaaaaaaagaaaaaagtgtattaaagaaggtcatcatggtcactgtctcttaatacacttaaaaactgtacttctggatctagggagattgctgtattacctctttctctacctgcaatttgaaaacatcaaatctatttgaacttaccaactcatttgtgttatcaccttagggaaacataatgaaacttaaggccttgctttcccatgaagtactcaactgtcagctttcacttatgaattgttttctttttagtatgttttgatcctccagcaaatcctacatagtggacccttcttcttttggaagacacttacctgagttataacttccaaatttatgttcacactattctttaaccttatttaggaagaaaaatttccctattaacacattatcaggaggtagtctcataggcaagagggggcattaggtagctgctgatgtgatttgcttacctatgtctggtatctctgtttctagggtgcacaaggtatccacgagtggcaagcaaaagcaaacagagagtcatcagtatcattgaacatgccaaacctaaccagacacaccaattcctaactcagattgcggcatttagagagactctatggggatcatttagtcaggcgtgcaagccaaagttgatccaatccctccaggctttgcctcctaagatggtgtcaaggcgattgcatattttgtttggtggatgcgcaaagttctaaggcagatttttcaaaaggttctctctggaccatctgcatcagaatcacttggattcttgcacttgtgcactttcctagggttctccctagccctactgaatcagaatcttgggtggaggtggggcctggaaattttacttttaacaaagttggctggcaattctgatgcaaaataaaatttaggaaccattgaactaggggttgaagaagcagccacggcagagggactaaccattttaggctttggtttgatagccataagcactctatcaaagtgtaaaatcactgttttattatcaaattgtgtgtacagacagacatcccaacactaaccctaagccacttatctgatctcagagataagataggaacatctgttgtgcaaattccttagcaatattaaagagctccttaacaagttgaaagtgtaagagttttcttttagaccatgacagaatatccctgacagcaaaactgctgatcaaaacaacttcaataaaacacattgtacatcaactattagggctttgtgtcttctagccatccatgctctaaagggcaactggggtaggcactagaggactgttgggccagaagaaggacaatactttggtggctcctgatctgtaagcctcttggcacagggtattgcctagggcatttcatgatgggacctgatatgaggtttctcacacagggagtgcagtctgtgtataggcctgactttgggtcaagtctgcccagaattaaaaggctataatcatctgtgaaatacgatcattttaatttttaaaatccttttaaatctggccctatgtcattttgaaaacatagagataaccatttttttatctaaactaggaaatggtcttattctttggaatctcagggaagaagaaaatatacaaaatttttcatctgaagttatctgctacagcagattcaactctttttaaaaagaacctttctgagattttactagttgggccacaggtcaaggttcactgacttttctgtttcctttgctcatctcaaaagggtaggtatcctgtgggttgaaacaaaggtgaactgataaggatgaggagctctgattagaaacctggccgcaggcatttacgcctctttcaatttgtttgtctctagaaactttcatttgcacctctttcaatttccttgtctctagacacttgcctgtttttgtggcctctaaattatagaatgagtgtgtttgagcctagctgtaatcactgtggcataggtgctcctcctgaaagtttagttgtgaaagtactagaaggatctcattaaaatatggtttcatcagcagcagattctcatggtacagaaccatttgtgtggctacaaagggttttgaaattcttacatgatggcaaggagtgagagggggatggtttgactttcttgcagctgcttctgattctgccaataatgtcactgtgaatttggaaagatgtcccatattatgcagagcagcttctctcattaacatctcagagggaggaagtgaaaatgacggaatttatttccagtgtgtgaccttgttctgtctcagaattacttttcgttaaggatttaggactgagccaccaccaaagtcagtctgctatctagctaccaactgactacatgctgaggtgtcagtgtgtgagctcttcacaagggcctgggcccatccgtgggcaccaccacctggcaatggaccaacttgaagcttgccatgagttaggaggagaaagaaatggaatttcaaatctttttagagcaagacatgcttccaatgataaagtctttaagttgacctttgattttctcaagatccaggtgatgaaagggtcatgtactcttcttttttaatttaaaagaaaattattgatatgatttatataccataaaattcacccttctaaaatgtgtaattcagtggtttccagtacattcagagagttgtgtagcctttaccattattcaattccagaacattttcatcatgctatgaagaaactccatacctatttgtggtcacttcccatttttcccctccctcagctccaggcaaccacaagaatacctattctggatatttcatataaattgaaccgttaaatatttgtccttttatgtctagcttcttccacttaacataatgtaccatctattccttttatgtttttgtgaggtaagggatggaaaagaggacatatgccaattttggagctgttttctagtgacctggcatcatgagactctgactggcctgcactgtggtggctgcagccctttacttgttcttcatgctgttctcagcttcttttcatattcctggccagaaacatttgacattgaagaatggtctgcccttcctgctcctctttccttggtcttcttgctttagacatcagagcacactcctgactgtcactgacttctcaggtcttccaactccagcgaccctcatccaagactaccttcccccatgctctggctctgttccttgcccttatcacaacttacctgtcctgttttagggccctgttttcagctagcagtccctttgaaaagcaatctgataaatgaatccatatcaagggactcgtgaatgcttttagcttgatgagccattctaaaagaggttcatgttttcggaaatcttagagatgcaatatttcaattcaaaggaacatatttcttagagtgaaaattttgggcaccatggaaggccagtgaagatgtctttgggtgaggtggagggaatccttgagtaccactgctaatacatgagatcaaactggggaggtaaccacctatttcatctacacgtagtgtttctagtatttgtagctccaatgctgttgacaagaggatggttcatggccatttctgagatatttgtagagctctcaaagctccatttccatttgttccttcagcggagagctctacaagttctcctgcctctcagcattctaactgcccctaaatggctgctattccagttctactccattcccagtcaatgacaggaatcaagtccagagcacaatgtatgaaatattaagcagttgctggaaaagaaacaggaaaatctcaagagaaattttcatatcacattgacatttgttgaatccaaattactcaagataccaagaagcatttgccaggctcttattttcttatctctttcacttttaagggaaggacaaaataaatatctggagaataacaaaatcttgaacaacagcagcatgaggtttttataaagaataaatcatttccagtcatgcttaatgagttttctaatagagttgtgaaattagaagatgagaggggtacagggggatattacatatttgaattcttgcaaagcacttgatatggtgtctcctatttttacttacataattatccctgttggtttcagaaaacttaaaagtggtcctgaggctataacaatttaaaaagtcagctaagtcataattgatgggaaatagttgaaggacttgtagatgtttagactgaggaagataaagctcaggaacctatgacagctctcctcacacttgtgaaagttgtcaggtaaaagagggaagtgacttctgtactgttttagatgctaccatttgccactactgagtgaatttttcacaaacgcagattttggctgaatataaggaagaattttctaatggagcagtccaaagatgcaacggatcttgagaagtattgaagtttcccatgattgaaagagatcaatgtagagacaacaaaccatcaggcatggaatgggcacaattttggacctgataccctcatggatccttctaatactaagctcacaaatctgtgatgtcatttttgttctactgaaatctgtgtgtgggtctgcatacatggagcaaatccctagtgaaaccaactcctaaactatctcacatagaagtgaatctatcttaaaatttttttcaaggatgtatttttaaagtcgcagaggtttaattgtatgatcttataagctttccttctttattatcttacctcaatctcccactggaaggaagctttaagatgcatacatacgaatgaaatctgcaggaaacaggcaaaggggtactatatacttaaataataagaaataatattgtttctcttggcagatttctaatgatagtgatattgctgacttttccttttcctccttgttctatcaatggaaataaatgattggcaaccaatgaaaatgaagttatttttgaggtcagatgtttcaattggaaacgtttcggatcaatagggctgaggcagaaaatatctacagtcctccaatctttaaactgccaagggacatctggaattactcgatgtggccaaatatgaaacaaaaggatctagaagggcatccattaggggcaaactatatgtcctcccaaaatgtcatcaaactttgggctgagagctacacatctgtggatctctaaacaggttaaattgtatgtgtcatgtaagaggatgctcaagtataaacctgaagtcaattttatagataaggaagagaactactagagaacatagtacatcagttacataatgaataacctggcagaggatcaaaatctataaggctctctatcccattctacaataatctgttgacaatattgcttctccattcacaattttaaatacaaccaataacataatggctatattcgtctgtgtttccaaggaaacagatgactcaaccaagtaaagtgactaatttgcatggggcacagagcaattaaattaactgatcttaagaaaaatactggtatgaagtgaggtttttatctaactacagtagaatcaatgaacattatggttcttaagatagcacagccttattaaatcaacttatttctctccaggaagtttaaatttggaaaatttataaagcaaatatataaatccacaaattatatgtacaatgtacagtacacatataggcaactgatcaggatagatgcttttttttttttaaaagtgaatctaataagagctatattagcttctgagtaaacatgacagctaatgacagctaatgtgtgctgacataaactggtttgatggttttgaatatagtcaaacagttagggagttacctgtcaattagatcaaaatgatcatgtatattccattagcttatttctttgatggccaatcacaggagtgttggaatagagaagaaataattgccttttctccttgaacctaatgcaggggatattaaccatgagtctatcaaagggcttcatctacagggactggttgctggtggggcagtgggaggcagggaactctaaggaagggaaaaaaatgcgatcccttaaatcacatatgccattttgtgtgattttgttttctctagggagagggtccatagccttcagtagattctcaaaggagtctaacactaataaaaaaaaagttaagaagaactactctaaaggatctcaactcagaaaagccggctagcttgagaaaagctctcaagctaagtgagagagccttgatgtgtaaattcaaagtgtgtgcatgcctaagtgaagagctgagacaatgagagaaaatagtgtcatggaataagaatgaatagaggcattggatagtacttcaaactgtcaaaaactaatttttctttatactgtgaaaatcagtttgcaattagagtccaagttattctattttatacttcaaatggctttgtattgaaggtcataaggtactttggactaaaatgcaaatttgtaaactgttaaggatccttgaccaaaagagaatctcatcaataaatgacaattgctccactttaggtaaatttacgtttaaattacaaagaaaaggactaaatttagctggagtttaaaaaatattaatataattttttgttttgtttttgtagataattttactgtttttcctttgaggagttagctatataggggttagctatacaggctttatagggttaactatgtagactcagcaagaaaaggtctctgtctacctgacagtctggatgactggaaacattcagatgttgaatgaattgttcagcgctcccatctatatttggcattatatagatagagcatccctagggttttgaaaacaatgtggactgttgtataaatcatttccacatccaggcatacaagcaaccatcttggccttcctgttgactttccagtaagtaggtgcccaaagagatatgctgctggaaatgacaagtccccatgaggtgtaacattctgaggtacatgaacacttgattagggtagggtgctatgaattagtacctctctagactctctaaaagtgctttgtctttattataaagtcttaactttacagtctgttttttcattagctaaaggatttaacagctttcttccctatgacagcctttgctactataattaagaaatgtattaaaactggagtgaattaatgtgaaaaatggatgggggcttgggactagaagatttccccagctaggtgttagggaataacactcagtattagaaaatggaggtatattccatagcaagcatgagaatctgaaaaattttgagaaatgccctttggactttcacatgcttgtgtgaaagtaagtgttaaatgaaaatgacccaagacttttcatgtgttttaattggctttgatgatgccatgcacatacaagttgctctgtcaatgtctatgctcttctagtcactatatttgatcactatttgtcaggtcattgaggagatgcctgaagaaaaaattgttttatggaatagttcataggatagcatctagatcttctgaacatagagaaacttaaagccaaatgttccagaggcatgtgtcaggaatacagctgtcataactagaaagaaggctctaccagtttacccaggggaaaggaaacaggtttgtttattcttaaggagacaggagttgaagcttcccttttcttttatttatttatttatttattttttattattatactttaagttttagggtacatgtgcacattgtacaggttagttacatatgtatacatgtgccatgctggtgcgctgcacccactaactcgtcatctagcattaggtatatctcccaatgctatccctccccccttcccccaccccacaacagtccccagagtgtgatattccccttcctgtgtccatgtgatctcattgttcaattcccacctatgagtgagaatatgcggtgtttggttttctgctcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccataatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaggtgtctgttcatgtccttcacccactttttgatggggttgtttgtttttttcttgtaaatttgtttgagttcattgtagatcctggatattagccctttgtcagatgagtaggttgcgaaaattttctcccattttgtaggttgcctgttcactctgatggtagtttcttttgctgtgcagaagctctgtagtttaattagatcccatttgtcaattttgtcttttgttgccattgcttttggtgttttagacatgaagtccttgcccatgcctatgtcctgaatggtaatgcctaggttttcttctagggtttttatggtgctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggtaatttacagattcaatgccatccccatcaagctaccaatgcctttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaaaaacaagcattggggaaaggattccctatttaataaatgatgctgggaaaactggctagccatatgtagaaagctgaaactggatcccttccttacaccttacacaaaaatcaattcaagatggattaaagacttaaacgttagacctaacaccataaaaaccctagaagcttcccttttctataacaccagaagatacacatttgtgtcttataatctcagaaagggaagaaataagtgaattaagccacagtcaatttagtcataatctttgtggaacttcaggatatggaatactaaaagctacgaattccttacaaaaggtgtcaaaatactttgtactctcaagaaaattcctaaaccatgtgagaaaatttaaagataaatgctttaattatcatggggtagggctttcaagggtaaagaaccatttctccctcctttatcatgccatgaaaaccagatttccgttttcttgtttatgaaatgaccatttccaaagattggaaataaaaacttatgaagtttagccttttggatctgacaatacctctcccaactagaatggaatagttttgatgagtcttcacagtggctagcagtgaatgagtgacttacttgagtgcttggaagtattgagatccatgtcagtgtcagcactgtttacagggaaggacatacatacagggatgttaacacttcctgcttctccaaagtagtgctcaaaggatcaatccttcaagtaggaagagtgagcatgttgacctttgtccctattcctgcatcttaactcagtgctacaataggggcaactacattttctgcttctactggcagtgctttgtcttttcatattatcttgctttttgctttatctgctaagcaaatatatagagattagagaagacttaccttaattccaaaatactaacggagtttcccgagggaaatattctccttacaaaattgaagtcgccaacatacacactgccatcagggccagaagctaaggcgacaggagcaaagagtttgttgttgtgggctgggccattgcagttggtgcaggctacactcctttggtgtccattacccattatggttgatatgactgggggctgctgggaaatgaacatattttctccattccctttatgtatgattcctagattcaaggaaaacaaaaagagaatttaagaaaagcaattaccacaaaataatctcagcaatattttaatttattcttcatcatcccaagcaggaaggagctttggcctggcataagagaacctgagagtgaaacacacactttcctcggttttgtttaactgcataaccacaacaaatagtagcataatactttgcctcagtttgtccatctgtgaagtagggtaatacaaccagtccttgtaatgttgattctaaatgactcaataaagcatttgatgactaacttttaatgacctattcactctgggctctgtgaatcatctgtggctacattttcatatctggctggctcttttctgatgcctagcacatacccgtctgacttcaaattaccctcactatgaaaccagttcctgaaacgagaatatcggtcaattttaatattaaccttagcaaaacacaatcaggaaggtaatctacttctgtgaaaagaaaagaaatcctactgctagaatgcacttcaaagaaatatgaaagaaacttgaattttccactcttttggaccatatcgcactatcatcagtgcaggaaatagagatactgacttatgaaaatgctttgcagacattctgtgtgggcaatctcatccatacccacggctttaactcccatttctatatgctgaaactttctcccatccagagttcttaactgacatgccatttccttctagacctctttacttggatcccccgcaattacttcagactggaacatacaaaaactgaactcattatttttctgcaaccactcccaaaccctgctcttcctcttgtgttccctaatcatcttgtgagtggttgtaccatgcatacaattacctaaattggaaatctggacatcaccatggctcttctttccccccattcttgaaacctgattaatcattaactcccattgagtctatcccttaaaatgtgttgaaaccagttctttctcccctattcctacattagtttagtttttcttaacttcttggtctcctggtctccatgcatatccatttccagatcttcgtccccactcctgccatagagattatttcagtctgtggtttaatacctttcaatagctccatatccctttaggataaagggcacattccttactgttaaggcacaaaaagtccttcatgatttggcccttgactacttcttcagtctcccctctcatcatgctttcatctatatcctgagatctagccagaacaaactacttatggttactttcacctacttccattcctctatgtttttgtccatgctattgtctttatcttgaatgccttcctcatcttgtctgcttggggaggttctattcatcctttaaagctcagctccagttttcctcaatgctccatccaggcagagtcagttactccctcctctgtgtgcccatagtttgttttccatagctctgttataacatttaccacatgtgtgatacagtttttattacttctctgtctttcccattagaacatgaatgagctccttgaaggcagatcctctgtcttactcctttctgcattttagtgccaatccctgtggccaaatcattataagtgctcggtaaatgttgaaaataggctttgagtttctcgtagtttccttgtctaaattccaatgattttgcaaacctgctgagcctgggcagaaaatccgaggaacaagtactgctgtgctaaatagctcaagtcagcccagagtgagccagggcaggtgaaacatccatgttgtgggaaggcatgcccatgtgtcagactgaagtcactaatagcaaatgaatgaatgcagttatacagttaagccttatttttttctccctttccccctgctgtctatctccttgcattgcctgttattctccctaaacatttcctgaaatgtctctttagttttcttccaactttgggtaccacagtcctaccacagaaactattgatcactctgaggtaggaacattgctggcaaaaataaacaagagggtaaaacatgctataataccatggtggaatatatggttggaaagggccttccagcaaacagaaatcccatccatcatatagtattggatttcaaatttaagcatttttacttttccttccagggtgatttctggctacttttgcaacacatgatttgcaggagcagctgtgagtttatgccctaacaaattggtcttttattgcagaactatgagatatcttgaggatcactactttcttattattttattaataactttattaggtagtagggacctttcttaagatttagaatagttaattaagtaagatgaataggactgaatttcttttctcaaaaaacatttaattgcagtgtggtcaatattgtaattcaaataaattaggaggaggtgaatgagaactggaatgacagttgcacaacatcattgaagagaaatctcccgatgattgctaacagaatattctacaaatgagactatgatatgttctttaataaatgaggaaaccactgtttagcatgtcagtatttcagcaatgcactatagtgtatatcattcaaaaatctttccaattattggcttggaaataccagatttgctattaacatctattttcacaggtagatctccatttttttatatcaatataatggtatagttaacaattaccctcaaaatgacatgttattaccagcctcctggcaattttagaactaaagatggctattctaaaccattcttctaagcctgcaattctaaaactccccttttctattagaaagcccaacactccatcaaagaagaagaatgattaaaggaaataaaacataaggcaatgtactttctgattacatctcaacaattgatgtctggctttcatgcaaggtactaaagtgcccgtgtactgaaatgaccatttctgtttaaagctgaagcaatcaaaacaaaaatgggcaaaccccttttgtattgccctggaaaaatagatcattttgaagggtgtttttgttgtttcaagaatctgtttaaccttccattacacagaaccagggcataccatctagcaaccatgatttaacaccaattcttttgcaaaatgttgctttgaaaatattttgtttatgttcctagaaatcttgatcaattactgctgcctcctttccagtttcttctgccacacatgctcattttgaaaagggaatccaatgatcctaggacaacacacattatttatgtgaaggccaacttcctgctaaggattgggtatcttgtttacagttaacgaaaccccactgaatggggcttactgcacattttctcttcaaagttttccttttctttgccaaaaagccaagcccattgtataataaggtaagcacacttttaaacataccagtcataccctcttgctactttgttcagaacttcttttgatgcttataaatatgtctgaaataaaaaatctccttgaaagccagtgggtggtgctttatgctgatttcaaggaagaaaccatttttcagatttatgaacaacaaagagacacaacacatatttctcttagtacttgactgagaggatataaacacaaactgggaggtatgccagtgtgatcaatggacatttacttctcctcccagtaaaaccatttgtcggcaaactactggcctattttggaggataagttaaaagaaattctttaccaattttgagacagatgacaatacccacttagtgccctagattgttctttttaataattttaaacactcgactgccaggaaaccctaggggatatgtttggtaaaagatacaccaaacaaatagcttagttctgtaacagatatgcacaactttcttataattttaaagaactgagttttcttaaaatgaatgaatataccctctttataatcactaagaagatgaacttaaaaggaataatgttgaaaaccacaagtttctgatgtttttatctcagtgaaaatcagaaccatctttatatatcaggcctaatattgggaaacaattctccacaaccaatggttaactgtcaggtaaatataattgcagcaatggaaatgacaaatggtctgaaaacactgcctgctagaaactacccattgcataatgattttggagccaaagaaaactgaagaatagaatggcaacagacatccagtctaattacaggtgtctttttaaccagtgagaggaaactgggggaagatagattcttgtttttaatctgctatctgtctctgatcaaaaaagcaggatgcctaaagagttacgtttttttccagagagaagcagagtgggggaatttggagagatgttgctcttgccttaatcagcttaatcagtcagaaaagactgtctgacccgagggggaaagagcattgctttctaaattggtcttcccaaagctgctccatcacacttatcattcctgcctctaaaactgcctttgtgggtgggatttagacttcgaaaacatcccaagagaggttttcgtgtccaaggtcaggctgaaaggcagcagcagagctggcttcagatctgtttcccggcaagtgtgatgagttcttggttggaaatacacatctacaaatgagatgataaaatgaacaaatgttcctttttaaaagactatccaaaggaaggcttctttctcagaataaatttctcagaaaggtagaaacacaagcagatttagtggggctgtgaatgagcacacaaaatcttttgggggtgataaaaatattctaaaactgggttttggtgatggttgcacaactacaaatttactaaaaatcactgaagtgtacatttataatgggtaaattttatgatgtataaattatacttcaataaagctgttaaaaattctcagaaataatttgatgcctattacctaaaaactaattactggtgaattggagataacacatttgtgaaaatcagggggccccccccaaagccaactttctgaatgactcccttctgttctgaatgtttcaagtctgtgtgaagcaaatggtaagaggatacaagactgggagcacacagctgggggctggctcgattgaggtcatttcccactttgtgtttaatgtcaatgacaggcatttgaaagagacaatccatacaagccaatataagtgagtggaaaagaaacggctgcttaaaatgtcaaactctttcaaatcaaaacagaaaacctaataatttaataagtggcatctgccctttcatttttgtacttttaaaactgtggctttccttttgacaacagaaaaaagttgaccttttatatctcagcctgaatctttgctcttaaaaaaaaataaactgtttgatatggaattcagaatcttccttgaaggaggagaaagagttataatgggggcatacagcaatagactcattcaccttcagagtcccacactgggactatagtaggcggtctctttctatggttgaagtaaatctggttagctttgccattcaaagtttctcagcctgtggggctggttgacatagctgatttggctatagtacagatgaagtgatatcataggtgtgattataaaatggatcccttagtttggtcagttcatggccttataagatcgcctcgccttaaccacctgttccacaaagttaggatggatacaaggatggctggatggaagtgtgtaggggcttcagtacattctgatccccaattctggaaaaataacccaatgtacatgtcctactatagcttgttcagaatctgtctctttagatgaaaagggatatgatttcacagtagacgctcagaggaaagctgtatgaaaacaccagtgacgggtttcccactaagatgcaagagtaggtgaaggaacttggatgaaggagttataaccagggtagcaaactcagtttgtctgggaaaagcacaaactcaggggccacctctgcccccttctcctgatttgtttaacatttaaatcgcaaacaaggagaacagcagggagagtggtccaaagaagggatagattaagatgagagtgttccgattcttaccacactaagagtaattcaaaatagaattattatgtttaatgcggtcatctctaagtagtattctcacaagtaatttttatcttgtactttccaaattttctgcaataaatatgtattatacagcattaggaaagtagtattcatacaaatttaaaaagctacttaccactttgaggattcaaaatgtgatgcttattcaaagaccagcctcctaggttagaagcatccatctcaaaaccttgtaaaacgactgtcctttgctcccagagaataaagtcagggcacgtttcatattcatatcccacagatactgcaaacaaagagttaacagcacattagaaaactgtaaaatatttgcttcatgtttatactagttgataattctgtggatatcactttggctactgaattctgattagagttgaaatttgactgcaaatttctttcacctagcacagtacaacattgcatctagcatagcattggtcactcaaaagtgatcagggcatatcggataaatatatgaaggagtgagtaaataaatgctcttattaggttggtaccatatgtttatggacattaggctttattttgggcttttgggttggaggctgtgctgtaaaactgaagagagatgctttctgcaggattaagctgtggtagtatttctctctgcctttgtaggagaagtgcaggtagggctggttttttaccactatagtgaaaaatgcactcagcaagctgcctttggagtactaggtcacttatacagcaaccaactacatatgcaactaatacaaatggatttgcccaatttatgttttcctgtgctaactggcttttggtttgctgagactaagtttgcttagagtgttgcaagtgtaaattccactttgtgcacgttatgttttggtttctgcatataactaaccaatgggacatcacccaacatttgtcctcaactgctatgcagcacagatgttgtacattaaacgtggaacctcggtatgccactgaaatgtgaaatgcagaatgtggtagcttgagagtctttgctctactgaactatgtatagcttaagtataccaagtcctagccattttccctcttggaaacctgctcacctgttggaaccccagatttctgattcttaaatttacaatgctttctatcctcataatgttctaagcctgagaacactggctcattatactgcatatcctgaagcggctttccctctttctggcagcttaaaatagcccctgttggtctgtggtctgccatagctttcgagtacctgcctctgcctgactctttagatgcccctgaagagctcagtccttcctttgtcatttggttatgaaaactggaagtgaaaatgcgtgcttaaacaatgccagaacaataggtccgaaagtgaaaaaataaagccaactggttttggtttttggcattaggtgaagggaaaagatggtaattttagtcaaactgatttgtgtgtgcatgtgcatgtgcatgtgtatgtgagcacattcacagagaagccaaaaagtccctgtaatcacaaatatccaactctctgactttgtggatcatttgtggccaattttaaattgcaggctggcttctctttgtcctccactctaccaaagcttataacagggatcagggccatcttcatggatacgacccatgcttaggagggccccacacttgatttaatgctctgcagtcactgtcttgaagtttgtaatactttttaaacaagaggctctgtatttccgttttcatttcactgggccctgcaaattatgtagccattcctggcggggatgcccttctatcagccatcagctggtaaagactcatgaaatgcagactcattttaatataatcctcaaccaagcgttattagcaacagaggccaacggactgggggcgggggaggaaactaatcgtctctgtcaatgctgttctctattaacagtggaaatagactctcagaggggaaagggatctcaaaggtaatctagttcgttacacttatggtacaaatcaatactgtctacagtctccctggtatctcctacagcccctctacttgctaaaacaactctggtaaagtgcaaagagttggttttggaccaagagttagaaaagacttcaactctcagatctatcattaactagctgtgtgggctcaggcaagttattctccatttctggagttgggcttttcactggtagcgtagtgggagggagtgactagaactggtggttcttagacgcttttgggtcagggagcactttgttgtgagtctaattaaagttatggacattcttcctggaaaaatgcatatgcgtacaaaattttctatataactctagggagttcactgactttctgaagtccaaataaagatctcagatcaaagacaactgtagtagacaatccttttaatccttctttagcactaacactctaaattgcattctttctagattacatttggtaacttctggttgaggatcaaacccaaaagccaaatagaacactgaatcttatgctggaaaaatcaggtggttagagagcacactgagggccatgttggtgtgtaggataacacagtttctgcttctcctgccaacatttaaaagtcttgattaataaataatcacaacgacaataattacaagttcccttaaagccatcatctccttccccacagtactcctggcaattactggatttgccttctgtacattgtaagtctggtgagctctcctaagaatcccttctccggaaggtgattgcgcagttttgcaaataagtagtgtgccctggtgacctgtgatggtggtttggagcctgctttttctctctcagtaacagttaaagatcctcccaactctgcagcaggaaatgcttacataaagcatcaattaaggagttctcaatgcagtggtaatgagacatacatactcttttcacctcctcctatctgctctctgaattgctctccagttcacaacaaaaaagtgcattggctgcaaaccccacaattatattactttttttccccagccacagcaaatagcaacaaggcaaccacttactaagttccctctaatttttattagatttactttctcccaagaaagctctatgagctaatgaagttataatttatatttaagacttgtccaaaatttccagctgactttaatgaggatagctgtgtgtcggggtattttcgtatgtggctccttgctcagggtaacaaggcaaagtttctttctcacagcagcccactttaacataatcctggaacttgcaatcagcttatgagaaggcaaatgtttcaccccatggagttgagcttctctccaagctcacaagaactagcaaatacagtagcaactaatcctagactttgtcatggaagcagactattatgcactaaatgcctacttttttcacataattaaatatagggaaaaaaggttacactgcagctggcactgaaaaccctgtcttgacaccatgctctgcctgacactatgacagctgagcctcagctaaataagcacagtggaccactaccatttcccaggcggcctgttgtctatcacgtctgatcatcaacatagcatggtacagggcacggattcagtctctagcactctggagtagggactagggagaatagtgtaatagaaaggaaaaaaaaattcattaacatctcagagaagctgtagaaagtagactagactggcagtgagcaggaataagtggataaggggtcctggactacacttcccaggggttagcataatgggttcgtgctggtgtgcatatattgagaaggcagttgagagtgagtaattattatggaataatactttctctgagccatgtgatcacctcccttgtgactcttctaatttcatctggatttctgccttcctgtattctctccttcacctccacacagagatattaacggaatgctccttaaccaagagtcactaattgtctagatagtcgtgttacttttgcagaggattctatcctctggtcacaggattgcacctctgacttcactgttagtcatcttgcaaatattacactggcttgtaaagaagactgagtaaaagattgtagcttgctcctccaaagccatttgacattggaaaaataactgaatgttcattctacttatcagagcagcagcatttgtatgacatggggatggcaagaaggctgagggtcacggcgtccctgataacttagtttagttactgtgacattcatctataagggctaggataggagattgacattaagtagccaaggtaaaggtgccatgcaatgaagctgacgtgtgaaatatgacaagattaagcagatgactttcaacagcttcaggctaaggcctcagaatttataatggttgcatttatgaaggcaatatataattacaagtcgtctgatagtcaatgtgagaaatttacatgttaccttcatgaactcagggaacatctaaaaataatttcatgatatttaaaaggtacctaattacaagatgaaaatcttcttctccgaaaggaattattgaatatagcaataaatattttccattcttttaaaatacaagattaatgcaaaaacaaaaacaacaacaaaagacaaaaaaccgaaagaaccaaatgaaggccatggcaaaatagaccaatactatgtagacaaaatactatctatgtaaaacaagtacctgctctcagagattcttctatctttccctattctctagtgatttatcgtaggataggatgagcccagaggtttctcaatttgacacactgcccagtggcctgaaatactttgtttatctattattcctagcttactaagagtgtcagaatcaggtgttgaattttcatcaagtgtctttttgacacttacggacaaattcacatagttttcccctttaatctgttaagacagtgaattatagcaatagatttcctaacgttgaaccatctttcttgccctaaaataaactttacctggacatgatgtattatcctttcagtgaatcactggatttgatttggcaatccctgacttaagatctttaccctatctatttacaaaaataagggttaaatatgatagtgttagagtgaggcagttgaatgaagagaaagtacaggtaggaaattaaaagaatccaggagtgagacagctatgcaacacttttgccaagaggttccgtacagtaaaacctgatattatgagatttttttctggctgctttgtccaagcctagctgcataaaagccaacatggataacctatattgccatcaaaggcagagtgatatactggctcatgtataacatttgtgagtgcctttgtgtacctgggcactgccctcctctctctgggcagacccaccattccattatataggcaaggctaagggatcaccctgatcctctgttggtattcatttctttgttcggtcattcaacaaatatgcaatatttcatgggtacctcttgttgacaggcagtttgtggggcactggggatatgaggttgaacaagacagcatccctccccccagtggaggttatattcaagtgggaagaacaaatataaaagtaaaacaaataacacacacacacacacaaacacacacacacacacacaaacacaaattgtaataaaggttatgatgggagaatgctgagcattatgagagagtgtaaccaggaaatttatgttggactgtggaggcaaggaaaagcctctttaccaagaaagggtttacctttataggggagggcattctaggcagagagagtggcatgtgtggaaggccttgagacttggtagctattgagagatttaaagaaggtcagggtggctagagagtcagtttctctccagtgcatcaaaaacaagtgaagaacaacaaccctccctgtccctacccagtaaaaaattgtaagattactatcccctagcagtatttaggcatattttgaggggaggcaggggttttggaaacagactcaccttgaaaatggactggctatcctttgaaacaatgtgaccgactaaaagggattcaatattgtaatggaaagtgaggtgctgttatttaatgacacagcaaaccttcgccaagctgctctacgtgccaggcaggtgatctgtgaagcactggagatatactgaatattatacagggaaggataatttttcatgtgagagaagccataccttgaaggattacctactttctggaatttttttttttttttttttttttttagacagagtttcactcttgttgcccaggctggagtgcagtggtgtgatcacggctcattgtagcctccacctcccaggttcaagtgattctcctgcctcagcctcccgagtagttgggattacaggcatgtgccaccacgcctggctaattttttttttatttttagtagagacggtgtttcactatgttggcaaggctggtcttgaactcctggccttaggtcatccacccgccttggcctcccagagtgctgggattacaggcgtgagccaccatgcccagcctactttctggaatttttatcaatgatctccctaataattaccacaaaataatatgccttacatttgtataatacataacaattagatatgtttttgtgcatatgacctaatttgaagactcaaactcatgaggaaactatatttactccagtttgatagatatcatagagactcaaagaaatgaagttattaagtccaaggtcacatggttagtaaatggcaaagccagagctcaaacccagtaattcataggcaaatgctttcatctactatgctagataacagctactaagggggaagacccgcaattcagtagtgctaaataaataactttttatttgttcagaatttaagagacaaggactggaagctagggatagccttgaagtagaggtgccatgtaacccaaatggccaaaaatggtgcttggttatgttgttttcttgatgtaattattaacagtatctccttttactctcaaaagtatctggtttgaatgataaattatgtggtcactcaatgttgaaggcatacctccgtagtcccctctgatatgggttggtagaggggaccagaagacaagaacagtcataaatgctgatttggaaaataagtcacatggtttgataagtcatttaatttttctgtttctgggcttatcatcttaccaatggcttttaaactttcatgtctgaaagtcatgatgagaaacacaactcgttaattgtgacccagcatccacatggggagatacacacacacacacacacttgaagtttttctgagacaatactgtctttgtagcatcacattctggtatgttctatttaattctgttcacttcggttctattatattccatcacattctattcaatttttcaaaacgaaaacgctggttgactcaccaaatagatttcacagtctactaatgggtgtgaccagcagtttgaaatgggcacaagaccacttgcttatgaaagtattagtgaaggccatttgaaaaccttggtaggaactcttacttttggatatcctatatcttataacccatattaaaatgtatacaactcatatcctacattaaacatatttcatatgtaaggatgaaaattgagttgtagttcacaagctgacatggtgctccatttttcagacacttatttaaacatttattaacgttgattttcagatttccttttcatcttctggtgacaataaactggttttttaggtagcaaacattttgtaggtccgtgaaaatctcatatccttggcactgtgcctatgaagttgaatggataaaacagccctgctttcagttaacgattatgaattcatgagtggagagaaatgatgaaagattattatctctgctagcttctctgatagaaaaccactggggcattgaattgggtactcagtaaggtgggttggttactttagtgaggagaggcagcattgaaaggcatacacaactcaggactgggagacctgagtttgaatccctgctctgtacaggactctaggccagttactttttctttctgaccctcagtttccccctctgcaacatgaagatcatgctaattctgccatgcctaccaggcaggaatgttataaggattaaaatgagataatatatgtgaaagtagtttgcaaattgtaaagcactactcatttattattaaaatattcagtggatgctatttttgtggctgcccaacctgcttaggttttactgaagggaaatttatgaacgctaaagcatcgttctcaggaatgttttgtgtgcacaaagcaaccatagcttagcacctattactattaatgttcccctgtttctctctaacacaatttagacagactcctatgtgtcgtgaacctttaggaagtctagttttcccagaaacaccattcttcgttgccaaactactatactaaataattatgcaattgttgttgccaataaccttgaagaaaaatagaattgtttatagcagagctactaacagcggatggctgatttcctgaacttccaggactccaaactgctgcaatttaatttaattaaaataaagacgaggcagaatgcattattacatattgataatgtatgcagacacaggcggacatcgggaattattttgacaaaattcacataatggatgcagatcagagcccctgaacaagccagtttgtcaaattaaataagccatctctagaattttaacagccctgtgaacttaacagtaatgatttttttttttacattgttttgcaagcagcagagttgggaaagaaactaaataaaatacaatgatttccagacatcgtactttatttagagtcaaagaataaagcactaagtccaaattatttaaaacgctcacatggagtttttagcaggggaggcttgtctgtgtatcagacaacaaaatctttaagccggatgaactagtgactgtgacttttgtactggaaccctggggatgattttactcttcttccacttgatcaatattgtacttggattaatcaatcttatcagttaccactgatacttctccaaggaaggagttcatacaacccctgtttgtaatttattcactctggtattatcccttcagttgcaaagtctgtttccttacaaaaaaatggtggtatatcctaggatctcaagcacttcttttctcattttcattgtctctcaacactctattcttctcttgtgatattctagcccttagagattataccaattccctacagccgagctacatggaaaacaagagtcccacaactatcaaactaatttagatattcaccatcactttaaattcagcttgtttaaacctgaacccttctttctccatcacccagaagtgagtgggccagagattcatatttaactggcatgggaggagaaagagtgggagatctttctagtcacagttttaaccaaaatcattgctctaactggactgcatgaatgctggtcatgtcttatattagtttccaatgtctgctgtaacaaattaccaaaaacttaaaggctttaaacaagaaaaatttctcatcttacagttatggaggccagaattctcaaatgggtctcactgagcaaaaatcaagtgtccatagggctgagttcctttccagaggctctaagggaaaatccatttctttgccttttccagcttctagtaggtgcttgcacgccttagtttgtggctctcttccctcatcttcaaagccagcaatgttgcatctctctgtgcctttcttccatagttatatcctcatgtaactctgacctccccttccactcccttctctgtttataaggacccttatgacaaattgagcctacccagatagaccaggataatctccaatctcaaatcagaagctaacaatctcaatttcatctgtaaccttaattctcttttggcatgcaacataacatattcatggtttccaaggatggacatctttgtgggggtggctattattctgcctaccaaatagctatactagtatttctgaatttgaagcaaatctgaaaagtgtcagatgcagcactgttgctggtgcaaaattcagtctatttcctcccatatcagttaagtgattacaaaatatcaccaggagtacaaatagacatttccttctttgtttatttagatttaatcataaatattaaggtatcagctcaatggttgtatatttgatcctatgtgtttccactcatttatcatctgaactatttatcatctactgtgttcttatggagctcacaatccatcttcagagtagtagattctccagcttcattctaccaactgttcagatgctttaccatggtcagaaaatggatcttttggaaacattatgccatgaaaaacaagccaatagataaatccatatagacaaaatggagatgagtggattctaggacttgggggagggaggagtggggagtgactgctaatatgtacagggttactttgtggagtgatgatgaaaatgttctggaattagatattggtggtagttgtacaaccttgtgaaaatactaaaagccaatgaattgtacactttaagtgagtgaactttatggtctatgaaatatacctcaataagcctgttattaaaaaaatgcagctgagctgcatttatgtgaaccctagcaagaaatgactactagatgctgtactggtcagctcttcatgagaggactgagaaaatttctaagtgtcacaatttaagaaaaaaagcaaaaaacaaaaacaaaaacaacccccatcgaaacccaactggggtctaaggaagatcataaagaattagaaaatatgaaaaactatttaaaagatcaaaaaattcaggtgttggttttttgaaaaattagtaagatatataggccactagctagactaataaagaaaaaaagagagaaggtccaaataaatacaactagaaacaacaaaggggatgctaccactgactccacagaaatgtaaataaccatcagaaaatactatgaacacctagaagagattaataaattcatggacatatacaccatcccaagattgaaccaggaagaaattggttccctgaacagaccaataatgagctctgaaacggaatcagtaataaatagcctaccaaccaaccaaccaaccaaccaacaaacaaacaaaaaccccaggaccaggtggattcacagcgaaattctagcagatgtacaaagaacagctggtaccattcccaccagaattattccaaaaaattgaggagggaatcctccccaactcattctatgaggccagcatcatcctgatgccaaaacctggcagagacacaacagaaaagaaaacttcaggccaatatccctgatgaatattgatgcaaaaatccttaaaaaaaaaatttgcaaactgaatccagcagcacttcaaaaagctaatccactatgttcaagtatgcttcatccctgggatgtaaagttggttcaacatactcaaattaataaatgtgattcatcacataaatggaactaaagaaaaaaaccacttgatctcaacagatgcataaatggctttgataaaattcaacacccattcatgttaaaaactctctataataaactaggtattgaaggaacatagctcaaaataataagagccatctatgacaaccccacagccaacatcatactgaatgggcaaaacctggaagcattccccttgaaaactggcacaagacaaggatgccctctctcatcagtcctattcaacatagtattggaagtcctggccagagcaatacagcaagaaaaagaaataaaaggcatccaaataggaagacaggaagtcaaactatcctgttggcaaataacatgattctatatctggaaatccccatagatttggtcccaaagctcctttagctgataacttcagcaaagtttcaggatacaaaatcaatgtacaaaaatcactagcattcctatacaccaccaacagccaagctgaaagccaaatcaggaacacacttccattcacaatattcacaagaagaataaaatacctaggaatacagttaaccagggaggtgaaaaatctctcaaagagaattacaaaaccactgctcagataaatctgagataacataaacaaacagaaaagcattccatgctcatggataagaagcatcaatatcgtaaaaatggccataccaccgaaagcaatttacagattcaatgctatttctatcaaactaccaatgacattcttcccagaattagaaaaaaaaaaacctctaaaattcatatggaaccccccaaaaaagcctaaatagccaaggcaatcctaaacaacaacaaaaaaagctggaggcatcacattactcaacttcaaactatactacagggttacagtaaccaaaacagcatggtactggtataaaaacagacacacagatgaatggaacagaatagagaggccagaaataaggtcacacatctacaaccacctgatcctcaacaaagctgacaaaaacaagcaatggggaaaggactccctattcaaaaaacagtgctgcagtaactggctagccacatacaggagattgaaactggaccccttacttacaccatatacacaaatcaactcaagatggatgaaagacttaaatgtaaaacccaaaactataaaaaccctggaagacaatctaggtaataccattttggacacagcaacaggcaaaaatttcatgaggaagacaccaaaagcaatcacaacaaaagcaaaaattgacaaatgggatctaacaaaatttaagagcttatgcacagcaaaagaaactatcaagagagtaaacagataacctaaagaataggagaaaatatttgcaaactatgcatctgacaaatgtctaatatccagcatctataaggaacttaaacaaattaataagaaaaaaattagcaaccctattaaaaagtaggcaaagggcatgaacagatgcttttcaaaagaagacatatatgtggccaatagcatatttaaaaaagctcaatatcacccatcatcagagaaatgcaaattttaaaaaagtcaaaaaataatagatgctggcaaggttgtggagaaaagggaacaattaaacactgttggtgggagcataaatttagttcagccattgtggaaagcagtgtgtcaattcttcaaagacctaaaaacaaaatttccattcgacccagaaatcccattctttgggtaggaatataaaccattctactataaagacatatgtacacaaatgttcattgcagcactattcacaatagcaaagacgtggaatcaccctaaatgcccatcgatgacagattggataaaaaagatgtggtacttatataccatggaataccgtacagccataaaaaagaatgacattgtgtcttttgcgggaacatggatggagctggaggttattatccttagcaaactaacgcagaaacagaaaaccaaataccgcatgttctctcttataagtgggagctaaatgatgataactcatggacacaaagaggggaacaacacacactggggcctatttgagggtggaggctgggaggagggaaaggagcagcaaaaataactattgggtactaggcttagtaaatgggtgccaaaacaatctgtacaacaaaccctgtgacacgaatttacctatataacaagcctacacacatacccctgaacttaaaataaaagtttaaaaataaataaattaggattataaatcatgctgctataaagacacatgcacacgtatgtttatcgcggcactattcacaatagcaaagacttggaaccaacccaaatgtccaacaatgatagactggattaagaaaatgtggcacacatacaccatggaatactatgcagccataaaaaaggatgagttcatgtcctttgtagggacacggatgaagctggaaaccgtcattctcagcaaactatcgcaaggacaaaaaaaccgaacactgcatgttctcactcataggtgggaattgaataatgagaacacttggacacaggaaggggaacatcacacaccggggcctgttgtggggtggggggaggggggagggatagcattaggagataaacctaatgcatatgacgagttaatgggtgcagcacaccaacatggtgcatgtatacatatgtaacaaacctggacgttgtgcacatgtaccctacaacttaaagtataataaaaataaataaataaataataaattaaaaggaattggaaaataaggacctatagagaaaaattggaggaattttggattatctgcctagtgaaggaaatgctgtaggataatatcatggagaagagaattagaggctttgagtatgattcagtgagggtctcagcaggaatgagatgtcgcacttgtaaatgttcaccgcagagagttcgaattaaggcatgggcagagttaagagaattatcaaggaagggagagccacctaagcactggcataactggtaagccttctgggcttgtagggggaagaggatggagtgatgatacagaaggcaagagagagcatggggatttggaggaggggctactagacaggggctgctattgtctaatgtagtctgcagtaaagcggggagagggataaataccctgagtttgttctctttctacagtctctagatggtgccactcattgaccaaatcaagtgggaagttaaagagcaaggtgttcagggaatgcagtccatggaagccagcctctcagagcacagagaaggacagaaaagagattatgcgtgtgtgtgtgtttgttgggggcggaggggtggggcgggcagggagggcaaatggagagtaagtagcacaaagtgcttgcctgttatactcacaacacccttcttagagaagctaaggcaacaaatacctgcatagactccatgctttatactatgtgatcacagtaccctggccacaacaaaatgaaaaaaagcaataccagcaactgacatttgttgaattcttacaatgtgccaagcattttatgttactcacctcatttaatcattatatcataacaaacctatgagtaacataatctttatgatattcactttatagatggagaaactgtggcatttggagattaatttatccagcgtcacacagctcgtaagtagagaaggaattatttgaacccggggaaggagtctggctccagagttgttctcataaccactacactcaatagaatagggattaagcaggactctgtaggctggtcagcaactttcacggcagcctaatgctaaagttctgccttacaagggtgttctggactgcacagtaaatggctgacacaatacaatattttctctaagaggaacctgaatatgagatacacagcaagttagcagaccacatagaatgtgaagagctgagagagagaaggagggtagttagtatggcaggaggagagatgaagtcagtcttaagtatggctgagtcaccactgtgggaagcagtggacttggaaaaacttgagctggttttaagttgacagagcagatgcagaccttctagaaatgcaatgtgtcctgaacaaggctataggttttgagtcctgcttgtgaggctaccgatggtatttcttgtactttcttatttttttgtgtgtctttacaataatttcccatttactgaggtaatatgaacctgtccatgttccttgcattccagtaaagtccaacacaaatgagttaattatttaaatatatgagggtctcttgggcagagaagagtcattagtctctctctctctctctctttctctttccctctgggaaaagaaaattgacatactatagtctaagaaatataggtcagctctgtaggaattataccatgctagacacttccaagggaggatgtctaaatgtctcttttggagagctttaaaataatcttctcatctgtccaagggtgatctacatgagctgcttcctgaaggtacaaggattaatggctcccaaactgcaggtctacagacctgtatcagagatacagaaaccttaggaaggtttctctgttttctacagagtgagagagataaagactttggtgttagtttatctctctctgagtgtcagggttcgattgcttgccatcatttcttaaaacagactattttttttcttttctgctattaaggtatccctcatatatgaaattatggtagtggtaggaatagtatagtatagtgagttcttttaaaaatattcttacttgacaaaataaaacattggcaaatctatctctgcctcattttaaaaaaatgccttttgtctgggagaattaaatacctgaaaaccataggcccaaaggacctcttaaggtccctgctatctataagattctaggttttaaagtcttgagattagagaaaatcaaaaggaataggaaggcaggatgattttttatttaacctgaagaagtaacaagttaatgaagtctaaccatcttagacataaaagatagtaagtggagatggccataagttagaattttgtagtctctaagtagaaatgacagtctaaatgtcaaatccaaaaacatggccttatagaacgccacaccaaaggtcacatttagaaggcagcatttggctctggtgacagttacaagtcagatattgcatgagtccattggtacgcagccatcatgaaaggagaactaaaatctttttgaagcaaaaatgtgtcaaaagggaactctaaactggcctcaaggtagtgtttaaattaaaaatgccttaggtcctttaaacagaagaaaatcagtaattattccaaatacaaattaacatgtaacaagtattttctgttctgtgcatgtaatactgctatttacatataattagttcaacatacccaaagcctctgccaggccccaaaccttctgtccatagatgtcggtcttgttccaagcaaatgtgtagacaagattaattgcggcgggaaaccacttctgtgtgagtcgcccttccacagctactgtgaggtgtacttttatcatgcctacaggaatcgttgaatgtgtcagaaggatccgtagcagggttttatacccaggggtgcggctgctcaggtaactcagcctcacaaagctggagggaatgggaatttcctcctgtacaacctgaaataaaaaaaaaaaaaaaaagccaaataggctcttgtcagtggtcgcaggtagatgaggatattgcatgctttgttgtctttgaaacatgccaaaggagagagcttaaacaggtctaaggacgtcaaggcatttgttcttgaatctttgtgagactgtatgataataggttttgaattttgcaccaaacctgaatggagacaagacccaaccttaaggattgcatttattttttccccatgccaggaaagattgtgtaaggaacaatttcagcttttcaatagtgttccaaaaactgcttagtaggagttgaaaaagatcataccgctgaatgtcaagcaattcagcactatgggctccattaaggggtctttttcttatacagacatacacaaaatcttgtttggtgttaagtcatatatcataaaaccattggtgtaatccttattcaggctaagctctctaagaggaagaactcaagaagcaggcccagcaagtgatattttatgacaaagattatagtttccctagaattaatctttaccgatgccatcaaattcgttttccttggagctttgaaatgaccctgaggccaaatttttaatcaaatttttcttacatatttctctgtgcctggatgtagcaatggctgggaacaagtttctccaagttggcacttgtgactgagaagcaaataactctcaccaattcctctgcaaattttacactaaacgttggtctcagagtaaaaataccatgtggctttaattaattgttattacttgtttgcttatcaccacagataaagttaaataaccaaaggtggtaactaaaattgaatcatgtgttctttgactttcatctttcaaaagacctctgaagaaaaagcccatcctattcaatacacttaaggtgacatgaatagcgtagatattttcatgctcttattcatttttacctcagaaccttgttctctcttacttttccaaacttgtgcacatagaagaactgattgttaaacatatggcatctcatattgtccagcatttttggtctttctcctgtttctgaggacacgataccttttgtgtacactttgccagtttttcttcctctaccttagccatttgataccagagttgtccaccagctgtcttctcagttggtgacagaagtacaatagagaaggatagcctgacactcaccaacttagtagttcattttcctaagaaaacatgcaatcctaaataagcctggaaactttcgtgctgaaagaagacccgtacttcctaatgacatctgtgaagggattggcataccaatcaaatgtactcattaaacactgtcttgttttttctccctttgtaagcaaagggcaatggaaaagataaggggtagctctttggactgcttttcctgaagggcagtatttttgtgtgagccttatctaagtggtattctctaggcactgctaagagctggtgggtggtgttatgatgaaagaacaatcaattctatcttggagcatgcatttccttctggatttctggatctgttaagacctatgagtccattttggtggtttccacatttaattatcattaaaatgtttctataatgtggtgagggaattgtactatggttgaatagtttaatattgaaatgacaatattgaatgttcaataaagaataattctcaggaatgttaaaatatcgaggttcaaaaatgtcttctcctgactataaagcttgaacactcagaagcaaagcttttttaaaaaaaaaaactgcacaggcttgaaaactacatttactttacacagctagatgagagaacttgtcatgtcttctaagaacaatgacaatgatacaaactagacaacaggaagaaaagtagatttctttttttttttttttggagacagagtttcactcttgttgcccaggctggagggcaatggtgcagtctcagctcactgcaacctccgtctcacgggttcaagcaattctcctgcctcagcctcctgagtagctgggattacaggcatgtgccaccatgcctgactaattttgtatttttagtagagacagggtttctccatgttggtcaggctggtcttgaactctcaaccttaggtgatctgcccaccttggcctcccaaagtgctgggattacaggcatgagccgccacgcccagctcaaaaactaaatttcttaaggagctttaatttcagaaccacaaacagtccaagctcatggattatactgttattactaataagccagctagctttgttcttagagcacagtgtttattaggtcaaagattggagtttaattcttatgaaagctacttaatcttgttctattccatggccacagacagcattctaatgccctgaccaattgtcttaaaaatgtatgccagaaaaacatttgaagacttctcttgacaaataaagggcagcacattataaggatggtaacaagaataggaaaaggaatttagctattatacactgttgaccactccatgatattattattttatacattcaaaggccaatatactcacctgcagctcaggaacaatagttcccctctctggacaggaccctccaaatgatgtgagcggtgaaggaagcacaatagggtttgggctgataaagttggagatatcgcaggatggcgggtctgatacaactctctgcatggtgactttctctaccacaataaactgattccaaggcaaccagagtgttctcttctcaggcaggaaaggggatcggtcgaagattaagatgacagagatgccaccgatggccacgaggtcaaagctaagaaggaaaaacataagacagttgcaatcaaatgaaaaattaaaaaattacagttaaaaaataggttaatttcagtgccctttcctttttggggggactcaactatatccacttgtattgtctattttataaattctctctagcaatgtattcattccgtagatgacttcttttcactatctagtggtcttctaggaagacattccatgtcaccagttgatattcccttgaaatttgtaaaccaattttttttttttttttttgagatggagtcttgctctgtcaccccaggctggagtgcagtggtgtgatctcggctcactgcaacctccgcctcctgggttcaagcgattctcctgtctcagcctcccgagtagctgggactacagctgcataccaccatgcaaggctaatttttgtattctttagtaggcatgggatttcaccatattcgtcaggttgttcttgaactcctgaccttagatgattcacccgccttggcctcccaaagtgctgggattacaggtgtgagccactgcgcccagcctgtaaaccagttaattttaacactatcttaaacaaaaatcactgcatgcatttctgcaaagccaaatctgacacagctgctccccttatgctaaagataacagaaagatgactatctaacatttagcagcatctttgagaatgatgcattattcattttccaaaaaatcctataatgtaacataagaaaagtaaggagccaaaaggttaaatatcttgttcagggtcacaaacatcgtgtcagaaagcagacagtgtctttgagatggcatttggagaaagatatcagcagaggacaattgttagggaaaatttctttgaactcagctatgcccgaccaagccttctacatttgactaccctctttggcctcctagtctacttgcacctcagatttaagatctctggtttgcttcacaatggtttttggtttctttttgtaagacagcctgtaatgaaccctgcacaacttcaccaacaactccttctctatccatgacaaagcaagactacctctgctgtaagccagctctgtctatctctagatgtggtctatgacaagactattgcattggagctgaacagattcagatttcatttcattctgcactagattacttctcttttaagtataatgacgtctttgagatgacgtacttgagagcatctgaaaagcataaactcctatataaaaaagtaagataatgataaattattatcatttttatgttaaaaatggataaagggcaatatgatgttacttaatattcaaggcaacttaaatccacaggagagagatgtaagcaattgcctgcattaaaaaagatctttcagcaaaacactttttcaacgataaaaagccctgatagggaatcagacttaattatggacatctcatcactctcttcctatgacatttattatatttattatagtattaccaatcgtgttttgttgcagaaatcttgcagataaagataaatgaacagtaacaaaggatggataataccgtgttttttattgctgctttttcagtaaagtagcttaatattaaggcagtttccaaaaagaggatttgaagaactgcattagctacagaaaataatttaggtttgaaccaaaagaaaaaagaaaacacaaacggtttatggtttaagacagagggtctgaattcataatactacaggaacagtttaaggcaagtgtagtggggagaatctgacactacttgtcaagaaacctttcctctagttcaccttctatgtggatttaagtatgtgttcttggggaagtttatctgcctcacccaaaccttgactcttgactcaaaattgaagtgcttatttatttaaaaacaaaaaacaaacacaaacatgaaaactaaataaactatccagataaaaacataggtgcctggaaattattctctctctttttaaaaaaaaacttttattctgtacttctggaaagattacacagacaggccaggcatcttgttttgtagaaagaatgtgggtttggtttcatatatatctgggtttgaatcccagctctgccctgttagctttgtgtctttgggctagttatttaaccttcctgagatgcagttttctcgttagtaaaatgaagcctctataatctatctcttagctgctattgtaaatgaatgagataaagacttaagggtcaagcatatagtaggaactcaacaactgttacatttcttctcaaatcagattcattgccctactacatttgccatatgttttcttttttttgtagttcaagtgaactataggtcagcttttgattatctccatgagcagatactgatttttaaggtctccttgggacttcccttaggcttcttatgatcgttcattttatatctctattgcctaggttatagttctaagttatttaatgaaacaccaatctaggtattgctgtggaggtctttcggagatgtggctattatctataatcagttgaatttaagtaaaggagatgatccttgataatgtgggtgggcaaaactgtttctgtgaggaagaagaaattcggccttaagaccactgcatctctttcctgagagtttccagtcttctagcctgcccgacagatttcagacttgccaatccccacaatcttataagcaaattccttggaataaatccctctctcaagacaataatatcaatatctatatctatgtcatatgttgtttccctggaaagccctgactgatacacttctcatctttccacctcgcagttatacacagtaaacactgcctggctgactcattaattgacatggagacggaaggtggaactgtggccagagatccatctaaaccatttccaatgccaaatagaatgctgaatgattacttctttgggatttctcccaccacaaaacacctccatttgcacgggccattaataacaggttattaagtcatatgagagtggatataaaagacccaagggagaggatttatttgtttggagattgttgtcaacacataagtccaaccagtcctatctacagatggaaggctattgacacctatgcaaattgcttatctctctctgcctcatggtatccataaatgaataaacttttgccttgaggagaatcaaagggaaccctctcttcatcttctagtcttcagaacaaagttcttgagacctttaatacttctcaagaaacttctaagaatgtcgtcacttcacctgttttgcttatcattagctgaactatttacaaatagttctctttcaacacttgactgaggactggttatatacctaagttgaaggtggtaaatcatagaagaaaagagcaagattacttgggtttaaatcttgaactctatccttattatctggataaattttctcatacaacaaatggggaggatgataataatgatatttatctcagatagttgtgaggatgaaaacagagacattcatgaaagtgtctaacatacagtagacactcataaacattcacctttcctttagaataggcttttttcttttctgctaagtagtcccttctctatgtgagtatctaatctcttcatacttttaaagggctcagtctttcaacaccatccttccttctgctttgaataaattactttggtcccatgatctagaccttttctggttctttagggaaacttgtcagtttacttttgcaagtagttgataatgggggtaaatatttctacatcccacatgacatatttgcattcaacggggactttgagagagctgacagcttcacccaaagcagtgataccattggtgaaaagtataagcactgtggccgactggagggattgagatttggacatggaggatcctatcagcaactctcatatcacactctctactaggtatctagatgctaatctcagcctttctatactcttttgacctcaggtatatttttcttttttcttttttttttttttttgagacagagtctcgctttgttgcccaggctggagtaacgtggcgcgatctcggctcactgcaacctctgtctcccaggttcaagcaattctcctgcctcagccacccgagtagctgggactacaggcgcccgccaccacgcccagctatttttttttttttttgtatttttagtagagacggggtttcaccgtgttagccaggacagtctcgatctcctgacctcatgatccgcccgcctcagcctcccaaagtgctgggattacaggcttgagccaccgtgcccggccgacctcaggtatatttttcttatgattttctacttttgaaatgtacttactcaaactgaggtagcaacaagcagagacatataaatggaaactctcatcacactgtcactttatgtccaggaaatgacagtggaacagtctggttggcatttggggcccatattttgaatgtttacacctttatggagcctgaggggagttattgctagaggggattctgactagtatctgtcatctacataaactcagttgtcactgtgagttcagcagaggaggggcttggggcatttcacttaaaactaaagacacaaaaataacaacaaagattaccctctttaatgttccctgtaaactgtacacaaacatttttagactttttaggtatcaagattcttttaggttcttgtgtgaatatcaaataattcaccgaaacctttgtatgtaagctaaaaaaatgaggtcttaccaggcctccacgagaagtcaaagtcaaatgtctcagaagacatattctatttagagaaataacccatttctcaatttgtggcatatggttgaagatgtttgcaagggtgaggctagttttaagcaccagttactggtgagtgcactaccaaaattccgttattcaatctaattgggagaaagacccatttgaattaatagagaactctgattatagaatatttgaaaggaaatgaagttttatatatatatatatacacacacatatatatgtgcatatatatgtacatatatgtgtgtgctaccaaaatagttctgctgagcttgttataatgaagagatggttagttagtaataagcaatataatttatacataaataatttatataatttactaaagtccttaagaacagtttattttcttaagtaggctaaaactctttcttattatctttttaaactaattttttataagtactttcttgacaggctcttggaaaaataaatccggcacagcccaagttgaacaattaacatttctaaagtgtctaggactaataaggtttgattgtaggttcttgaaatgagatagtttctcacagtgtgataaagctcgaagccaacaggtctttttttgcgtatgattattgaagtggcttgttatgagtaggacattttaagggtagtcacctggagactagggcacctcaaagccattattacagtgtccctgagagtcataaataggtacctttaagctggacacatgggcctattgacccaaatattctgaatcaatgtctgtctaaatgacggcaacaaaaatgttgttgtgagcaaatccttttccaggatgagaaggttttacttcaaggtcttgcttctcagatcttagagaacccccttagagagcagcctggtggttggtgcttcaggataaatcactataattaagtaggctggccaagcttgtctatcagttgcagccaatagtcaaataggcagcctagggaggacacatttttaaagcttctccattaatgtggtggaattctgtacttttggaagaaatatttttgatgcattcatttctgaaatatttgggggttactatggaaaaatagcctatgtgttccatagctccttatttatcatttgcataatgtcactgatctttgaagttggatttatagatggaattagataaaggatagaaaacttttcacatggcctgggtttcaagaagactcgagaaggattagaagaggaatccagtttgaattaattaggaaatagaggaaataaatatcaccaatgactttttgagatataacttgaagaaagatgggtttaccatcactgtatcatctgagccctggttttacccctggctagaagtcagtaattggcccccacaatgatcagaaacaacattgacataccttccatcttgccggctgatggtaaacccataatcactgtggtgcaagaaactgacattcactcccactagaggagttccatctatggccaccacttggcctcgaatcacacaggcacgcctgcaacacaagaccaaaggcaaacagaaaagcatgttgagactagattctagaagtcaagttgtagaaactttggaaaacagtcaagtataacaaagaaaacaataatttcaccaaccagtagaaaactactaataacattctggggaggagtttttttttttccccatcaaaattagaatcatactaagtatggttctgaatctagatattttaaggttaaaagcatattattaatattgtccaatgtatttagaaattccttaatatatcatttttgttattatataatacacccttaaattagtatcctataacttgcttaacctacccctgattttcggacattttgttgtttcttaatttttttctgccttaaatttcttattatttccttgagagagagtcctagttgtggaatgatacttttctcttatcaaaattaaagttaattacattagttaatacataaatatattgtaagataagactaaagtccctactgaccgcctttttcctgcttcttggtgttctcatcagaggtactcagcactattagtttgttgtgtgcattttctatgcatttacatatatagtatgaatatttttaagcctcctgatatacactgctaaagtgcctttttctggtaaaacaaccagccaaccaaacaaacaaatttagttgagcacactttaagttaaagtctgcaaaagagacatgatccctgacaatggtatactgcttttcttgcctaatttaaataaaatatttcaagacactttccctttaaacaaatgagtcccatccttactaaaaaatggaattccattaaactagtccctaaatagggctctctttcagggacatagtccactaaaacatacaagactttcagcgctagcctggctgacaagctgtaacaaatttcaggaggctggcagttaagaagagtgccctgggacaaatcccaagcaaggatttttttcactggtctgctgggaggaagggacagttttttcaccagagtttaatcctagtcttggcagccctgagctcttggacatgaattttatagctggagctggcagggttgaggaaggttgagcaaggtcagtgatttttcctagggcatcaataccacctttttttttttttttttttttttttaaccaagtgggattctgggtatccagggcagctcaatcttggattaaaggggaccatgttattcagacaaacatggcttttcagattaatcctaatcatttcatcctggaattatacattcttttaacagaatcagaaagtaaagggaggaatgtaaaggctcatggccacaaacatcatttgagagaaagtaaaacacctttgaataagctacagatggtagcttataataagccagagttggttgtatatgttttagccaataaacctcactactaaattctgttgcaatcagaggaattggttataagttatgctaataggatttatcctcttctacgtaagggctttcccaacaaaagttacaagccattaagtattacgcaaagtaagcgagtgtaattgttgctattagtgtttgtgtattttctgaactctcagaccaacattcatagctctgtgacatagatcagtggcttttttccagtgagctgtccattttatgaattatgtaaatcatggttctgagtggcatgcaaatggcatactggcacttgcttcgccatgtttgattgtcccaatttctgtatcattttgaaatcccatttgttctaatagagaagacatttgaagtcattgagttctggattttgaactaattctggcagatctggtcccaggttctaagtccaatgtaacaagaaatgaaaataaaaggacatctctgattttatacagtaaccttttagatgtctttacagagcaacttttgacaaggtgggtgtagattgaatggaaacaagctgagaaaatctcctgcaaatgacatatggattggttccaggggggctgtgaagagactgtagtgatgccaaacaatttagaaattagttaagcattgtttcctgagctctcaatgctgttagctgctttgggagtatggtgggggttagttattaccttgccaagcctccaccagttaacaaggtggcctttacaacaataacacctacctaggtgcttgctgattccctattcgcaagacaattccaaagtcactctttttatttgctcacattaatctagacattgtgtctttccacagctgtactaggctcaattatttttgtttttattttgtcaagcctagttggcattattttctcatattttatgacacacacagacctgtctctcctctctgctgttcttttattttctatatggcttatatttatgaaggtccaagctggtgagtgaaagtctcataaaagttatcattattctgtgcatttcccttgtattcctctcttccttcattctgtatctcgttctgagtagacttgtcttttgactcttctgcttcttaatattcctcatgttttatgaagcacacatatttgtgtgataatgactcatcaaagtcatcattattcaagacactgtctacctgttcttcttttcattcatttcactcttcatcactcataaataatgctcacagacttgtctttcaactccccttctttcttattcctcatattttatgatccacacaaacttacagcatatgataaaaccccataaaacttatattctacatttatcagtattgaactccctttgtaatgtattagactttaaatgttccaagattccctgtatcttgctgcatttgctcccattatttatacactccatgtcatccatttttcacgagaataactcttaggtctttttattcctggattactagtacttactgtaatctttgaacaatatcagtcatccagtgtcagtttaaattgtctaaatttcaggacagtattaaagtattctttttaatttgcagtaatcttgactgacactgcatgcagaaatttaggaaaaatctacctcttaggcaaactctccatttcaaaaagaaagctcttgagtgtacttgctttcccaggcaggctacatcagctccaaatggccattagggagccttcatatatattctttggaagtatggcatattgtgccacttcgttcagctcaactgccattttgtgcactcccagattctaaattctattttcttaataattgtggatggtagccttgtatctggtttgtttttcctgattccccacagccactaaaatatagttccttccctcccatttatataaactattttgattatgcttcttatatctaaggcagcctgtatagttcatttttttccaaagttagatcctagctgagtagtgaggtatgtacggtgagggtctgcctttgatattaccacagtcctgctttctgtgtttttcctattcccattatggtgcctccctgtttcctcttccagagagtccctggcttcctcaaatcaccattgaaattagtcagccctacttggcctgtacttggtctgcctcgaggaagcatcttgagttcttgaatttttgccacatcaaaactaccttcaacctgagttttggtccttaaaaatttgtctttttctgaaacattttcaattcaataatatatagaactcttctaaatctttcaagtaagatgatagaagctactgtctggactgtcatgcggctggccctgcacatgtgtacagcagctatgtgcccagcataactgtcgtttgtgttggttttgtgtgtctatatgtgtggtcttgtgtacgctcaacggcaggcattgcatactttctgtctttgcttgggctctcctttgattcacagacatgaatgagatggatgctttgcttggttgaacctttgaaaacaagaacttctccctgctgttgttggttagagcaagataacttgaacttagatgggcatgtccaatgtgactctagaaacatgcatggggaatatcacccctcacaagtgtcttttttcctgttctctagagaatacaggctgctgccaagctgtctacctgctgtcactatgctaaagcagcaaccccaaaggaattgcttctccactttaactaaatgctgaatcctctaggtgtttggagcttggtctgaagaacagagcatcttgggaaatgcaggtcagaatacactttactgggagccttatttaactaacaagctgcttgttagacagttctgatgcaaaaggtctaattcattctgtatttgttattttcatggaatagtcaaattatccctagccttcaatcaactcttggttccattctcctcttcccttatttgttgtcttttgtcttcggtgtcaaatctccgatattcgtttaacacctcaggcaacaacattaacctcaagcacaatagttggtttgaaaaacaaggctgaaaactaaattgctgaaagaagatgcaatttactacattgcatttctgattaatgtctttcgaaagaaaacagactcagggctagaaaagttacagcgatttccttttgttgctaacaggagcataagcagcctttgaagggtaacattcaaaatcaaggacctagccagcaggggatctagcagcaggtgggcaggttaggttgttttttttccacaggaacagatgaaatcctttctacagctgacagctctggtcaaaaggtagcactgagaaggactgggctgagagaggctatatgaatcctctgctcactagtgtttgaatcctgccccgtaaattcctctttgaattgtcagttggttcaagtctccaagggatagaaatttgtcacatatgaggtgtgactggaggattcccctaacaactgtagctactggggtctctgttggaatgcaaatatctctgaatagttaggacaaagggtttgtgatgttcctgttaccactgccatcacatagtgaataaaggggcttctctttagaaagtaattttgggattgtggtgttggtcctcagtcctgtatgataatctctctctcttatagatcagtgattctcaaacttgattgtccacgagaatcactggaaagccttattgaaacacagattgctgggtcgtatcctcagagtttctgatttagtaggtctggtgttggatcatagaatttacatttctaacaagacaaacctttgagaactgctgctttaggaaaagcaaggccataacatactcagccaattaaggcatatgaactcctggagagggaggcagaaggtataaaccataaaaaggcaggcaaatcgaccactggttcacaatcttacccttatgaaatctgtcaggcatgaattttaactcttccatataaacttctggaaaagggtttgcaacaactgtagtttggggagtcatgttgaaactgtcatgacaaaaggggtggctgtactacaagatgaactacagggtcttcaaattcagagattataaaatggaaatatgttttagtccaatttatttgtcccaaataagtgtccatttctcctccatcctcattattcttattatacaatgctcatacttgtgttattgcacttatcataaccggtcttggatgacagttttagatctgtctgtctttttattagatagccagggcaaaaactgtgtgattttcttccctgtgtccttctcagagcctgatgtacacagcacatgctcaagacaggttcatagaatttcaactcaaatatttaaaaatatagttgtaagatccttgcaacctatgctcatggcactgcttcaagcaagggcttcagtgactacgttgagattcctgtgtaacagatgccttacactttatttattagaagccaacactctggattgagcattaggacattctcatcaggagtgttttgtttgatacttgactattttagggaattaaacagtacctattgtgatcgggaagatgaaatgattagtcttcaaatgcttaatttatgcacgctagccccattcttcctttatatattattatataattactatttgctattttataatttaaatgcatttgggacttctaatatccagatattttgggggtttccttacaacacgtgctacttttgatatatgttatctaacctggtacagcactatgaaaacacttaatgttatagcataaacctatttccatgttctgaaaattcaaatgcagtgaatgctcatatgcaaacccaatacaatgtcctcgttagtttttattttaatatggtgggttgatttaatcctactcagttggtcactgccccaaataaacaatgcctaccaagtgggtagcattaaaagcagctgggagcattagccatcaacattctaggactctgggaaaggtggtgctattgaaaatgcagatagatttttaagcagaattattttcctcatggctagtgatgtttcaagtaaaacaaaatgggggcactcaccctgaggtagggtggctattttcccatctgccttggtaattgcttgtcaaaagtacgcttgctttggaggtctgagatccccaaagtaatgggaaaaagatcaagtgttttgaagcaataagaaaactgacgacacagtcacattttcaggactgcgtaagtgccagtttgcttcatttagacacatgattattttcgtccagaatttgaatcctgaaatatttgtcctgtaagcccttgcaactcttgaatagtctgaagttagtttttcccttaaaatttttggtttgttttttgcttgttctacacatgactcaaatgttttctctttgcaatcagccttatagggttttgttaacctcattaacctctcttgtcacttctctgaatctgcctttcgactaatggatagtcattaaatataggacagatccttcttgttggccatctcctgggcatatattactcttccctccacagacgaagaagtgtgtctttgctctagccacagctgtgttctagctctggcttgctagtaaccaccattgttgacttttcctaagaaacagaattaactcttagctctgtttgctctttatgtagggtgggaatgttctttcttccctgacctctccccggttacctcacaaagatgtcatcatagtaaaattacccagtaaaatgatcacttttgaactaggcctttcaaattctattgctatgtaccctgataattattagatatatatgttgtataaataaaatatttattatactatgaatcaggtactatgccagatactttccttaccttatttcatttaatgtccacataaccctgagtaggtaaagctattaggcccatttaaaaaatgaagaaacagactcagagaagttaaaagttttgcacttaacacagctcataagtggtggaggggtggagatctcttgacctggcccccaaagagcctgagctgtattgcagatctttctgagtcaagatataaacaatatggctacaaatgaaaagaaagtgatcgcctacaaagatggtgctatctacagaattatggctacctggagaaatttaccaactgctgagcacttcctatgtggagtgtgtgtagtggagatgagctatagcatgtcatttgttctttcttcccaaacttgcattcactttgtcctctccagggacaaaatgagatgacagaaccagctagagagtcattacaagcaaatagtatgactgagtagtaggtaataaggatttgagccttttaactttacatcctaatggagcagcaagtaggatagataaaatattagaaaatacctattcatgctgagataagttgtaggtagctactggtatcattaattataactgttaagcatctcagaacaactgagtttcaaagtatcataaatcatcagttgaaacagccttttgaagatctgtgttctgatttttcattcttctttgcccaagagcatttgcaaagaagtgaaagtctcacattgtttctttttggtacctttaggtgttgactgctgatttcaggagacagtcagcactataaatctgggaaccttctgcactttgtaattttttaaatgtgttttgaacatgtgttttctgaattttagcattagacagtatagtctgaaaatcaagagatcccatcttcagtaacacctttcacatgaagatcaaagtgctttattaggaagcagcaacaaccgtacttcccaattaggacaacaacttcagaggtgataagcaagggagattgctcaggaaaagcaacggggacagacaaacagaataacaagtaaccacggccaatccaaaacacactggaattctttttccaaacgtgagcaggtcatctgcagtgccttcctttagaaaggaaggtgaacagaaggtatatttgaggatgttgatgctctataaagagcttacccgattcttagtctattcaatttattcagcaattgtcgcactgtgtatttatcaacccctagttgtgtacttggtgtaatgtttttcatgttcctagattaaaaatacccaaaaatctgccattagcaagtagacttagaggtctttaacaaatagattcatgaaaaagctaaacgcaaggcatatggattcaaatttgtacctcagtgaaattacaaatgtttatgttgtcgaccttctggggttactcgtagatagacaaaactgcaacatgttaattctgtgaatgcttgaatactgtaatagcactatatttccttttaaatattttaaaatataggcttatcttttaaaaataattccaaatcagtaagtggtttctcaatatttgatttattctaggattaacactaattgatgaagatctgctatttttttctgtcatgcatgagttaagtggtctaaggctgttactgatttctctttccaggtcctagtcagttggtctgaggtattcaaattttctcaatgtcctcctggagggcaggcacctcatccatttatcggtaaaacccagtaaccaatatgcagtaattccttgacaaaggtttgttttacttttccattgcacattatgtcacagaattttgattcaacaggcccctaaaagtcaacagcaggctccagtttctgttaaaatctattgcataggggtccaggtggcaagaaacatttataccaagatcatctaatatacagatgaatgctattcagggttctgctctagtgtcacctcctcagagaggtgtccctgggccactctgtgtaaaatggtccttctctgtccctaacttttatctcaccttacagtatttataccttcctgacatttacttttttcattgtttgcctccctcactagactgtatggggaagagattttgtccactataacccagagcttagaagagtacctatcactaaatgaagaaatgaaccaagtaaacattataatgttcatacatttaaagagtgaaatgattaatcttcccccaatagggattgtcttgaaagaaactgtaggatctattgttttaaatgactccaaagtgtggttaatggggatttttttttcattgtgctaaatgggatttcttttggatgattgttttttttttcctggaatttatgtttggtacacacatttcaaattgtagagaaaattatttatagccccaaatgtcaaaggatgatgaaactgtttgcatatagttaagctgttcactgtccaaataagctttgtatttttcttgcaagtcatcaatagtctccagtgtgtgtcaattttagcagctcttcatgctcacccgagccaattagtcccatctctggattattgctgaaaacttccaggtcagtttcacttctatagttgtttaatgactttgtctaatttgccagaatacttcttgtcttacagggctacctgtcttccccatcaaaacagttgaatttggactcctgagctgatgaactccaagctcccttagaaatctgatgttccatgatccatagacttactgcaattcataattattttaattatttatgtatttacttgatgttttgactgcttctgccactacaatgtaaactctgaataaggggactgtgtttcttttgtgtatctccatctgcacagttcctggcataaagtgagtactcaataaatgttgttgtatgaatgagtgaatgcatatccttcatcactcttgaaaaatgaattgatattagggtattatattacattaagaatggcagaagaatctggtatctcttctatctctttctgaggtagtaaagtcctcagtttctctggaaataccaatattgtaataaaatatatacttaaaacagtaattagtatctgtcaattatggttattcttaagtctcagtctttattcaagatcagcagcttctgcagcgatgaccatcttcctgcaaccttccctcgatctcagtcttgggtcaataatttgttttgccattcacagaatctcaaatggtatacattcccagctcaactgagggcagaacgcatgttacattaaacaagttatgatgagtaattatggctgtcaccaggtatcatgactaatcgggaacaagaatcaagaatgtattattgagtagggtatagtaaaggaggatgaaggcttaggtaaataaaaagtttgccaaaattccatgttcaaggcatttgaagtacttcagtttgttttagggcacttctctttggttttcttgcgagacagaataatgatgcacaccaaagtgagccagttagcagcagtcttcctgctgacctcctgatattgctccttatattccacttttctcttagcactaaattttgattatctaacccattgaaaacagaattattgatgcatacacaaaatcataaatgatgtcaattattggcaggttgtgacagtgatggaatatatcacaagttttaaaaaagaataattattttgctattgttatattatcactatatctttcatgaattttgtttctctgctatttggagaactgtaatcttacctttaggctggttctacatttgagaattggattatttaaggtcctaatatcatttgtgtgttctaggcaaccaaaatgagtttttcattagcaaatatgagaagagcatgatatagtttgtatgtttgtccccgtccaaatttcatgttgaattataatccccagtattggagatggggcctggttagaggtgactggatcatggggatggatttctcgtgaatggtttagcaccacctcttggtgctgtcatcacaagagtgagtgagttctcatgaggtctggctgtttaaaagtgtttgtcacctccttctctctttctcgctcttgctttcaccatgtgacatgcctattgccctatcaccttcaaccatgattgaaagcttcccgaggcatcaccagaagctgagcagatgccagcatcatgcttcctgtaaagcctgcaggactgtgagccaattaaacctcttttctttataaattacccagtctccagtatttctttatagcaatgtgagaatgacctaatacagagcactcacacttcaaaatcataactaagctactcactcacttgtttttcacctacttcatgccaaatactgtgttaggatctggggatacagtggtatcatagattaaaggtggccaaaaattatttgatactgctctcatcaagaggtgggatctatgtccttccccttgaatctaggcaagctctgtgactgctttgaccaactgtgtatgacacaagtgacactgtgacaatttctggacccaggtcttaagagactggcattttccatttcctgtctcttggaacactcactcttggagccctaggctaccatataagagctctgacaaacctaaggctagctaccatgccagtaggaggcccaagtagtcaaatagagaggctacctgtagagagaaggatttccatctgctgtccagctgttccagcccccagttatttgagtcatcccagctgaggcttccaacatcatggagcagagataagccatgctagccatgccttatctgaatgtctgacccatggacacatgaaataggatgatactgaattgttttaatccattacttggaacaatttgctacatagcagtagatattcaaaacaagaagagaacaaatcggacttggtctttgtccttacagaacttaagatttagaaatgatgacaattcagagctaacattgtacatcctagggtgaaccaagaaactgaaatgcagcaattccaaagaaagctagaagaaacccatcatcttgtttcatttttttttttttttgcttgttaatattgctattatgtgcctagtgctgtactaaatttggtcctaattctagaaattttcaattaagggtaggcattccaccagagtgggcagaagaggtcaacacaattgattcagcaggactgttgcaagattttagatctttaagctgttcttaaaatttactctaagttatagacataataatcaaattcctgcgaacatacacattcttctcataaaatgtggacttttttcctactttggtgggaccgggattatctgatataatgggtgggatgttaagacatcataggttaagatccactggcctagaggagtttattagcctaaggtgtgaggcagagtgtataccaacttattcatgagatatgcaaaggtactccagcgaactaaggggagaaatattgttccattaatgtgatttctagatcatgttcagtcatctttttcctctttttaaaccactataataaaagttcaaaaattaagtgaaatgataatgttgggtatttaaaggctctcagggaaaaagatcagaaagaaaaacaaacacttaagatctttccttggaaagctgcagaaactgtatagaccagaaatcacaaactcaaatgccagcaaggccaggcatgacattgaaagtgaaggacgtgagtcaagtgagtggtgagctagaaaggcatgccatgtcccatccagaggggcagctggcccttaagcgtcagaccacctatgccgtgcccatgcatcctaggttgcccatgcatcccaagctgtgtaaattttctggagaaggaagatattctgatttttatgttggatctcctaatttctaaatgtcaggacaaacaaaatacatctgtgggctgattttaagcaacctctgatatggacatctgacacggattgacgtgaggatcagcctctcatggttacaaaacagacagatgagtttggttagaccttgctgtcagccgctgcactaaccctggtaagattttgtttttttaaatgcacttctccactagtgatggcgagtgaaatgtctggctttgcaaattactgctgtcatttagtttaatgtactcctgcttttacatatttataaaaaccttttacattattaatagtgattaaatgcttagacactaaagatcaataatgcttctgttcacctatttacatttttaaaaagtaataagtcgtacagggctcgtagaatatgtggtttactttgcagtcatgtttggagtagttgaagaaaacaaactcgagctacaggatataaattgcatttaggaaaaaaatggcaactcagttgagtttgcccaagatcttcaccatgggcagggtgcacgttcacattgttgttacaccatcacacggcacagaacatacatattccatgggctttcacatgtgggtgcagctaactcaaaacaagaaggtctggtctctcttggttgcacaaggataaacaattttttagcttttgtgtgtccttgcaacacttagtcacctgtgtgccaccatctttagctccaaaggtttctgatggtggcaacattcagcagcaaatcagctgtgtgggtcgcattttgccggtaggcaaacaagccccttcaaaatgctttcttcacccgcctacccagctctctctctcaattatgcagcaaaaactaaaaagcaaagtggtttgttcacctgattatggcacataagtgtcctagatctgcctgaggagagcaatcctacagtccgagatgtataagagccataagtatttcacattcagctagcccagctttctaagtagccaaaatggcccagcatagtggtttagagactaggctgtcagcaccagttcaaattctgggttcgaaatctgactgacactcattaattgtgaccctgaacaagtcatttactgggcatctctgttcttatttcctcactgacaaatggagatagtaatagtacctaccatatagagtttttgtgaggattaaataacacatgtaaaagtttagcatgagatctttgacataacaaatgcccaaggacaatttacatgtatcaaaaggtccatttcatgagtcactcaattgtgatctacaaagaaaaaattcattagcactgatttgaagtttgtaaatgatgtcactgaaatgtattaaattgaactggatttttaaaatgtcatttggtttctaagtttcttgtgttgacccaaataccatttacctagtataaatttggttcacgtcaccaggcttatttaaggacccattgaaatggggcagctgtggcgtaatggaaaggttacaagagttgctacaatgcaagctttctgcatgtgtgatttggggcaagttatttaatctctctgaacctcagtttccttatatataaaatgcacctaatacaagtatctactttacagggataatgtgaggataaaaggacataatgtatgtttgtttgctttgtaaactaaaaagtactatatagatgtaagagactgtagctattatgatttatatatatgatcagagttggacttattttgcccaaagatatcccaaataaaaatgcatgtgttgattttttagaggaaatagaattagattgtttgtcctcagctactttcctcacgaaaagcctttgccttttctgatagaatggatatatttgtaagagctgagacccctggatgaaggagacccatcgttctgaatttaaatgtgacttgcagagccaaatgataacttggagcattttacaaaagaatgagggaaactcaatcaaaccaggaggaggagaagggcattaaccaccacaagaaataggtttattcactctgagcggctggcaagtgctgctgatgcatgaagctaaaccgcagggatttaagtttgtcctcacttttctaagtttattgctcacatgctctgctctgggtcacaatgacttgtctcttgtctctcttaggtcttgactttctccccttacttgagtttagtgagtcatttaacacttctccatgtcatggaggttgttatttctttcacttcatttcttttttttggatcaacttttctctatgagtgaagaaagctacagagttgatgtcttacctctaccttaaataggaaaacagggataatggttgctttttgttctttttgttcctctggtgtataataaataagtctcgactatctaaataatcactttgactataccacatctgaaagtcactgcagagttgttattgaagctggaagaaatacttcaaaatggagatgactgaatctcttggaagaaggaaaactttgactagatcccctggcagaaaagccctttcttgtgattcactggcagttggattttgggttctgccagagacctagagagtcagaactacacaataaaaaaaaaattttaaacttttaagtttcaataacagttctagtatacaactgaagggaagggagttgagagtttgaaatttccatgcacatcttatttttccccttttctactatgtataggtcaagatggagttgtaattttcttagattgtcactgatatcaatataaactcttgaccaagttattcttggggaatgataactcccaccaggctgcaactgagggagtgggatgtagacaggagttcctggacaaatactttccatgtttcttaaaaattcctgtttgcaacagtctacaaagccagtgaaatattgacttgtggaatgcatacaggagaacatttttgtgtctggaaatgttgactttagtgacttacctctaatgctaattagtaaaatatatcatcgctgaagatgaattaaagaataacagtgagcaaattcatgttattacacttcatataagtaagcttattttaaaaaaattatttgccttatgggttgggctttggtctgaggtcttaagtgacaattcatgcatttgagctttcccggaagacagatttttcacgagtcttgcatttcacactaggatgtcaaacttattcaaccctttcctatggaaacatttttcatcatgaaataaaacttaaaatttagtttttgaaattcaagattttttcaatgaatcaatccagaagctaaacaataaatttgcaaattatatttccctcctgtttttgttattaaaagccatattatatatatacatacacaaacatacacacataattttatgatacagaatctctagaaatgagttttttccttaatcagtaagggttttggctttccagagaagtcctaaaaagaaatgaacgtggattatgtggaatgggaagtaacctgatccttagaagatatcttcctttcgtagttcaggaaaaacatgaccattgttcactaaggaataaaataaatacatatgtacctgctgtcaaatgacacctcaggaggaatgacatgagtactgtccttgccaatgaggaatttgattcgatcataaaaaagtcttgaagtgtgctgagagaagagagtttggctttgctgaatgaggtcaagaggatctggtgagccctggcagagaggacttatataacagttgctttgttgacaacagtcaggatccacacagtcggttaaaccatctggaaataaaacccaaaaccaatattgattatttagcttcaagagaaaaatatagtttaaaatatacataaatggagaaaattctaaaatatagccaaagataatcaaccttgttttgagttcagaatttgttaaattcacatttttcatgaattatcactcactctgagttcacatggcacctcagagaaattcaaagtattttgttcataaatttttctttcctgaattatccagcatttatcagctggagaatatagtttatatagttattgtttagagtttgggtaaacaattctattacatatcactgtttagaaatttcttcttcctcagtgagaccattctttccgaatgcgatgatttcttgtaagtacacctagtacatctatgagcacacaattaacaagtacttgctacctgaatttgtatttttttaaaaaatcctcccaatattgttgtctactggtaatgctcaaaatagaggttgggattctcatggtgaaaaaagatatttcgagcaatgattttcaaatctgttgtcaattacctagggagcttataaaatatgcatattcttgagctccacctactgactcagaatttttacagagcccaggattatgcatacttaatctgggtgattctgaagcatactaaagttgcagaaccagttttttaaggaatttatagaaggaactagagttaacatgcctaacagcagttttttgatgcaattactattctattttatttattttttgagacggagtctctctctgtcgcccaggctggagtgcagtggcacaatctcggctcactgcaagttctgcctcccgggttcacgccattctcctgcctcagcctcccaagtagctgggaccacaggcgcccgccaacacacccggctaattttttgtatttttagtagagacggggtttcaccgtgttagccaggatggtgtccatctcctgacctcttgatccgcccacctcggcctcccaaagtgctgggattacaggcgtgagcaaccgcacccagccgatgcaattactaccaaatctgacatacatgaatgcgatgactttctctgtttcattttctggcccttcaccatttgctgtagactgctgaatccactgttgtaccacaaataaaactcatacaaaggctttgttctttggtagagaaatgatatagggaacagggattgtgaggcagggagaccactgagaatctaacaggtgcaaaatactgttaggtgcttgcagaggtgaagagataaaaatacccttttcctgttttcaagagctctgggcttagtaggagaaagagatatgtaaacagctaactcttatactagcaaaaatgtaagaagtgctttaagagagttacatgcaaagagaaggggttggagtgattaactgagcatatggacacttcattccatgccccataagcaaaaaaattaaagttcttcccaggtccttaaagaaggcaagtggctctaattcagttgtttaacaagggtaaatataaagacactaatcttcttggcttgccttggaataggaaggttcggatggatcaccgtctccttaaggctgctgctgcagcaagttactagcactgatttcctgcagctcttttgcttgctctctctcccccacttgtctgctcccgtggagttagaggcgggtgtaccacagctgggggcaatgaaagcgaggaacaccaagagagtagacgtttggaacagcagccctagggcacccaggaaatatttttccccacatgtggtcctttcaaattccctgtactatagacactactttgatttaaaatgcagtttgctttttttcttgccttccctgtttgttcaatgtgtttttgcccctgatttctatttctctgtatacatatttttttcattgatgactttttagtgtgaatttgtttcaataagaagtttctttctgcttccccttttcccatcattcagcaaattatattaacagattttttagggattttagataccactaccacctctccctccaatacgctgttctcagcctcttattagcacattatctctttactctgctaattaaacatctggatgcgctgaaaagctggcaaaaatatcaggctgattaagagagttctctgatgtctggaattggtgcataatgcactaaacaatgaaaaactgcttttcaaatgggcagtcacttttacatttttattgaatactgaatttgttattgagctaatatatgtggaagtatccagtgtcatgcctggcaaatattaacaaatacactagtaataatcacattgggcagtcacaggtttcaacctgtcaaccacaaaattccgacttatttttgaaaataaatagattttaaataaatattaatgccaaaaacgatcttaaaaaaaaactaaaaaaatctaaacatagaaccaattcataattgggactcacattctcatctagtaatgttctatacattccaagctaatgtttcatatttaatcattgcctattatgtagggctgaccctttaagacctctgttttctgagacatcagcaaggctcctgttgagtctagaaagacctcaggcaagccgatcaataatggcatgcaaaccccgtattataatttgtaggtaagtccagcacacgggcaaagatgaacttaccaattatcacattgactaacaccccatatagtacgtctagactgttgcaaagaagtgcaaatgacaatcacactgaatatgtgccttgttttttggctattaacagtttttttttttttttctaattgttcagaattggaagctgtggcaccctactgacagccaagctcagcgtcgtcagatatgggcatgtcaaatattaactgatttttacttttagggcctgttctcttcaaaggaataaaaatactaggtagctaaaaaagagggaggttacactgacttgaaggactatctatggcattcattgatcctagctttgccaaccagtttgggactttgccagttggctcaattggtgttgatgaagcactggtttctttgctgcgtgatcaagtcatcactagtaaacttatgcctactaattgtatgcccttggctgaaaggggaaatggatgaaggaatatgagtgatacagaggaaacccatactttctaatcctgaaaatgaatttacaaatatatatcctttagagacagcacttgtattatcaccttgataataatgggtggttaattcatggtaggttatacaaaaggatttgaaaacacgtacagattagttaatatttgccaggcactaggtacatccacgtatattatctcaacaaatcccttcaacaagcctgttaggttgatattctcatccctatattacaaacaaagaaggggaggctaaatgtagttgcagtgggaagtaacctgggagtcatatgaacacctagtgttatgcatgcaaatcacacattcacatcatcatctaaacagtgtgtattactagtactgatctaggctgtaggacttccaagtgcatgactatacataggtatttagagcacatgaagtggttaaggtaaaaaacaaaacaaaagaaaacaaaaacagactactttggctctatttttttttttttttgagacggacttttgctctgtcgcccaggctggagtgcagtggcgtgatctctgctcactgcaacctctgtgtcctgggttcaagtgattctcctgcctcagcctcccgagtacctgggattacaggcacctgccaccatgcccagctaactttttgtatttttagtagagatggggcttcaccatgttggccaggctggtctcaaactcctggcctcaggtgatcaaactgccttggcctcccaaactgttgggattacaggcgtaagccaccgggccagccctgctttggctctaagcttaacgttgccacttacaatctgtagaatcctagacaagtcagttcctcatttgtaagatgtaaataacaataatactcactctataagttgttgtaagtatcacatgctataataaagatgagattgggtgcactcagggtggtatagccatagactggagaacattaggctaagtgaaataagtcagtcatagaagggaaaatactccatgattgctcttatatgaggcatctaagatagtcaaacatatagaagtagacaaccgcatggtggttacttggggattggttatggggatatgaggagttgtttaatgggtataaagtcacagttataagatgagcaagttctcgtacaacatagtacttatagttaataatgaggtattgtgcagttaacaattttttaagagggtagacctcatgttaagtgttcttaacacacacacacccacacacacacacacacacacacacatacacacacactccaccccagaacaaagggacaagaagaaaaccgttggatgtaatggatatgtttattaccttgtttgtggtgatggtaacatgagtttatacatatgtgtaaactgaccaaattatttacatttattatgttcaggttttgtacaccatttatacctcaataaagctggaaaggtaatcataataagcttactatctagtacataaccagcacttgataaatgttagctgttgttattatatcaaattctaaaacatacagactgcaaagaatctaaggatagagtcttaggggtagatgtcaatggtttgcaatggcagcttaaagcattcaaccccttttattgaagttgccttatcactggccagagggtaattgatttctgtgtagcacgttccagttgttggaatgtgttcattttatgaactatgcttggttaggttgtcaggtaggtaggatcttatgtgactctgagtagacaaacactaatactacagaaacttttcattcattggatttgattgattcagaatttgtcaccatttggacaggggttggatttaagcttaagcttttcagcatctgtagaacagtgggtctgctgagcaaattaatagtgaaaataaaatggaagggctgatcattccaatgactcagtaaagcaaagtcttcttaggcattttagaaagccataagcaatgaactaactataaatcattcataactctttactaaagcaggcctcctactaggcactcctgttagcttagttgttgcccttacatgtattgaaggtaataggactgtatttcctctggaaatagtctataattcatattcttcatttcttcaggctgattttcacccctggatttactgtattagaaaaaagaaagtgagagagactcaagtgcactcaggattggcctgcccaaatcattattgttgctataaccacataccattaaacttttctgggttgggaaaatacgttgtttgtatgccactaatgttcatgtcctcctggtgcctacctgccattgatggcttttcatatcacttagaataaaagcctaagtctgaacaatgacttattacctcacagtctgattctttgccatctccctcttacctctcagatcttacctcttctgatccacccaatctccttcccactcctctggctgttccttaatttcccaggcaatgttatcaggacgtttgcacacactattcctatgcctggaatgttcttctccctggtatcaacatggcttaaccttcacctcctttgggtctttattcaaatgtcatcttcttagtgagattttctctggctaccttatttaaaatttccccgtcctacactccctgtccttccttttcctgccttattttaatcttaatttttttaattttaaatttttgtgggtacatagtaggtgtatatatttatggggtacttgagatattttgatacaggcatgcaatgtataataatctcatcatgaaagatggggtatctatcccctcaagcatttatcctttgtgttacaaacaatccaattatactattttaggtattttaaaatgcacaattaaattattgactgtagtcaccctgttgtgctatcaaatagtatgtcttggccaggtgtggtggctcacgcctgtaatctcagcactttgggagactgagggggggggtggatcacctgaggtcaggagttcgagaccagcctggcctatatgatgaaaccctgtctctactaaaaatacaataattagccgggcgtggtggtgggcatctgtaatcccagctactcgggagactgaggcaggagaatcacttgaacccaggaggcagaggttgcagtgagctgagatagcaccattgcactccagcctgggcaacaagagtgaaactccatctcaaaaaaaaaaaaaaagtaggtcttattcattctttctaactatctttttgcaccattaaccatctccaattcccctttaaatccccattacccttgccagcctttggtaaccatcttgcctttaaaaaaaaaaaaaaaaaaaaacaaattttcttcatcacatttaccaccttctatcataatatgtatttttaaaatttggtttaatttctgcctcttgtaactagaatataagctttatggaagcatgaattttatcttttttatgcattgctatttcctcaatgactagaacagtacctggcttaaagtaagcattcaaggcccagcacggtggcttacgcctgtaatcccagcactttgggaggccgaggcaggcagatcacttgatgtcaggagtttgagacaagcctggccaacatggtgaaaacccatttctactaaaaatacaaaaattagctggggggtgagggtggcatgcacctatagttacagctacttgggaggctcaggcaggagaatagcttgaaaccaggaggtggaggttgcagtgagccgagattgcaccactgcactcaagtctgggtgacagagcgagactccatcctcccccccaaaaaatgaacattcattatatatttgaataatgaataaatggatgccataaaagtcctatttctatgacatttgtaaatgtgcccagagattaacaaatgtccaactaatatatcaaattgttattaacagattcttcattgataacacacttttattgcccactttaaatgactgtatttcaactcttttctcattcattttcatcactgcaaagtagacagatatcaagtatcagtagccttagttggtagataatgtgatgggcccagtcatacagtggtgaacagttacagagttgagattttctactttgcagttgcatctggaggcacttgggcagtttaggctcttataactaagtgatgatccattaataaatgggttgcttcaaaattaaaggggtatggtgagaaaagaataattagaaatatgctttctgatgccaagtcttttgtctccaaccaaatctcaaaagtaaatgtgaagatgtctgcctcttaaatagagtaaatgttataaattcattgttccttctctttcattttcctatttattaaacactgaagcatgctggtgccattctaaacatgaggctcattgatccatgagcttgtatgtgttcataactcacccatggtgctgttttctggatctagaaacactacatcataaaagaggcttgcaaatagctattgctcttaatgaatggtgacttgttatgaagaatgattcctggaagatcattctcttttaggcaattaacttattgattttaccaatgaatatgaatatagaccactggaagagtttataccagagaagcttggacaaacgtgataaatacttaaaagatcagagaaaaaaaggctgtttggattaaacactcttactctacattttttgagcctccttgaaaatatttccacaatatcagagaccactttccttcctccataagtcgagtgaatgaaatggaatctttgtatggtaactgaagatcttgtaaaactcacaatgttctgtatgatctggcccctgactacttttctatactaatctcttcctgactcatgttccagccacaaagacatgccttttactttagagcctagtacatttccacctcagggcatatatacatgctgtttcctctgtctggaacgtttttcccctgactcatgtgaggcctctctcaccacccagactaggtcaggtccccatgcacatttatagaattacacaattttaaaattataaaatttttctagcactcttcacagttgtaaatatatagctatgagggatcttcaaaaagttcttggaaaatgtgtatcatgagaaaactatgcaaggagttcaaattttttttccactaaaataaagtcatactaacttgttgtaacacatctgaacaggatctagtttgaggcactaagaaggataaggcatcattttgaaaagagtccctgtcagagcaacatgaattttgctgaaattgaagcaagaacaaacatcaaatttacgatgaaacttgggtggaagaatgatgacatcactgatactttatgaaaagttaatggggacaatgccccaaagaaatcagcagttcacaaatagataactcattataagaagagacaagatgatgctgaagatgaagcctgcagcagcaggtcatccacatcaatttgtgaggaaaaattaatcttgtttgtgctctaattgaagaggatcgatgatgaacagcagtagcagttccgacaccacagacatctcaattggttcagcttacacaattctgactgaaaaattaaagtcaagcaaattttccacttgatgagtacaaaactgttactcccagatcagcagcagacaaaagcagagctttcaatggaaattttaaataaatgggatgaagatcccgaagcattttgttgaagaattgtaataggagatgaaatgtggctttaccagtatgactccgaagacaaaatacaatcaaaacaatggctacaaagaggtggacgaggtccagtcaaagcaagaatggactggtcaacagcagtggttatcccagcactttgggaggctgaggcaggcagatcacttgatgtcaggagttcgagatcagcctgtccaacatggtgaaaacccatctctactaaaaatacaaaaattagtcggaggggcgggggtggcatgcacctatagttccagctacttgggaggctcaggcaggagaatagcttgaacccaggaggcaacagttgtttggggtcctcaaggcattttgtttgttgtctttttggagggccaaagaacgataatatctgcttattacgagagtgttttgagaaagttagccaagggtttagcagaaaaacacccaggaaagcttcaccagagagtcctaatccaccatgacaatgctcctgctcattcctctcattaaacaagggcaatttgcaagagtttcaatgggaaatcattacgcatttaccttacttacagttctgatttgcctctttctaatttttttttgtttcctaatcttaaaaaatctttaaagggtacccatttttcttcagttaacaatgtaaagaagactggttaagttcccaggaccctcagttatatcaggatggactcatcccttacaaaattgtcttgaacttgatgtagaagtaaagtttatatttttgttgagaaataaagtttatattttaaaatatttatatttcaagtctccctttccatgagctttttgaagtccctcatatttgtgtggattatttaatatctacctgccttgctagaccataagctccatgaaggcagaaacttgtattgtttatcattttctctccagtgtcaagcacaatagttagcaagaagtagtaatgaattaatggaaaaccaggtacttaatgtgaaatgtttggcctaaaggtaacatttgagtgaaacatttggatcatcactatccaatataacttctcctaaagctaggaatgttctagtactgtgctgtctagtacagtagctactagtctcatgtggctactgagcacttgagatgtgactagtgcagttgagatcctgaatttttttatgttatttaagttaaatttaaatactcacatgtggccagtggctaccatactagacagtgtagattttgatgtctgcaaatatttagatattggatggtctacacatttagctaaacattataaaaaagttttacatttttactaagtcaaatttattgtttttttttcctattatggtttctttttatgtttacaaagtgctttctcattgtaagatctatcaccacttttttttttgaattgtttgttttcttttacttttaactcattaatccagttgaagtgtttttatttatcttattctttaggtatatggtatgaattaaaaaatctaaggcatttttcttaagagttgtcacagttccgtttatttaataatgcttattttaccccattgatttttgatgccagttttataatatactaaattttgtacttgggtgtgttctagagcttttattcagttgcattaatctgtctattctcacatcagtgccactttgctttaattatcatagctttcaaatatgccttaatgtctgatagttctatctttcactattgtttgttttagctattctgactcagttaatataatgtccaaactttttttctgatgttaattcatatgtgcatgtaatgtatggtgatcatatgtaaccaactccaaattaggacacatgattaacaaatgaaaatgtggtcaccatagtaagttttttcctccaagtatagggttgtgcatgtggtaggtgcttcttgattaaagagatgaatgaggtcaagacatttcataggtttgtgacttctatagtaattagttcttgtatatacaatacataagatagctttccttttttgcacttaagaaaaaacatccaaaggttattttttctctgttctgtttttactgttcaaggagcttttaggtagtttctggaccagcggtgtcacccacatattcaatgcagcccaattagttactgagaatcacaatgcattgaatcagagggtaactaaagtcaaagcttcaggaagtagcagcaatactaatgagtattcaaagctgattagaatgcaaaaaaattccaccattctttaagtatcagttataatatggagtaatcaggtagcagctacttgaagcaaatgcttgaaagtgattttttttgattgggaagatttcttaagaattacatttttaaaattagaactactttttcccaaaacggttcaattggtgctttctaatgtaattaaaacacacacatatacacacatgcacaaacaagtagactaatattaatattaagcaaatattaataattagtcatatttaactaaatgaaaccagccattatggatagctggaaagctgagactaccaaatgaagggcatttaatatattctcaggggtaatatttgaacagtataaaaatgaaattattggtttaaaatcttagtcatggggctttcagagtttattcaatctatctttccatctcaaagtagaactgaatctatatttatcatcaatatcatcttaatcctactatagggaaaaatggtaatcggaaatctcaaggagctttccccccgttccctaaagagacgatcataaaaatatactgagctcatattaaggtctttgatttttaatttgcatatagatacatagttttaaggaatgttcacaggtcaatacacgttcagtgaaatcttctatgtcttctgaatctacatagaccacaggcattgagaattgataattcattaattcattaatatttaattgatccattctttaaacattttggctgccttgagatgaccttgaggccataaaaaatggtgataattaaatattcaattatttttattactttactaaggcaggaaacattggctcaaccttaactgagccagaaattataattgcataggttgttaatgtgttttctgagcataacattttaatcaatacataactgagaaattcctattattataccaaatcctttttagaatgaagcagactacctaggtttatatccaggacctatcatttgcttactatgtgatttttaacaacttacttgacttctctgtgtctcagtttcctaatttgtaaagtagtgttaatggtagttcctggccaggtgcagtggctcacacctgaaatcccagcactttcagaggctgaggcagacagattgcttgagcccaggagtttgagacgggcctgggcaacatggtgaaatcctgtttctattaaaattatagaaattagccaggagtggtggtgtgtgcctgtagtcccagctactcaggaggctaaggcagaaggattacctgagctccagaggcagaggttgcagtgagctgagattgtgccactacactccagaatgggagacagaacaagaccctgtctcaaaaagaaaaaaaaatgttcctacataatggggattaaatgaaataattcacataaggggctcagcacagtgcctggcacatagtaaatcctgaatacaagtgagatactattattttcaacatattgggaatataactatgggcaatgggtcatgcttaacatgcaacaagaaaaccatatacagaatataattaggtgtttgattgtatagtgcatattatcaacaccatgggtaattgaggaggtggatgtcagaagtttcatgggagatatggtttaagttgagacttaaattatggacagagaacaatgggtggagaagacatgaagatgtgccaggtaaaaggtatataatgaaaaagacaagaaggaaagtgaagatgagtcttagagggccataaaaataaactaaatagtttatcagtggatcattagattgaaaacttcactccggtttccaaaacaaggttttcaagttatatgggtagtaaacagtctcttcagaaaatagtctcttctatttgtgtgtgtgtgtgtgtgtgtgtgtgtgtgtgtgtgtgtgtgtatgtgtggtgtagtttactatctttcaagtggctcacttgaactatctcatttaatacttattacaaccctattagacagtgtgtgtctaattattcaacctatccttctgtctcaaagtagaactgaatctatatttatcatcaatatcatcttaattctactatagggaaaaatggtaatatcatttaatatcatcaaccccattttagaaataaggaaatggaagcacagagatatcataaaacttgtcccaaatcatgcagctagtataagagccagagctagtatctgaatccagacagtttaacttcaaatctctgtgttcttaatcacaaagttgcctccacttaattttgataaggtcttaaaacttttaaaggttaactgttagccagaacaagtaaaggaagaaactcttataatgcagtttggtgcttaagccatgactgctaccttattaatataatcctgcctcatgtctgaattcaaatgacaaggaatgcaattgtctaagcagatatagaaatgtgaagtgtcaaatttaataatatacttcattttaagctaatatacagaaattcaaacaaaattttttgttaattttatgtttcctcgagtagaaggtatgtggaaagtgaggatttgttgttttaggctcactcagaggtggtttgggcagttttgatgtctgatcatacagtgtgttagatgttttgttggctttcctaagagaagtggtaactctgaggtcttggagccacagtggttttaaaaaatatcatgcgcagctccttgattaaatatttaaaattctaccataaattgtctcgatgctatgtcctctgaaaggtataaagtgctactaaaaggtagacacacaagagggagttccaaataactaacaacaaagaaaaatattttagcatgtctagtgcaaactatgctaacatcaaacaacttgaatagtggtatgttaatttaatttgatatgataaatgccatgggtatgggaggtagcatggtgtagtagttgagaaaatatgctctgaagtcacatagccctaaattggagacttggctctgctactctctagctatgtgattctggataagtcacttactatccccacccagagcattaattttcccatctacaagtggggaaaatagtaatacctatacctcatagggttattgtgagaattaaatgatacataacacatgcaaaaaaaattggagtactgcctggtcatagtaatattcaataagtaatgtcttcttaatgtgattgagactaaaaggtagcattaccctatataactcagtatcatttatactagagattcctaattttcacccttggccaggttgattaccactgtgctagaggctgggctattcctttcttacgtgaacattttataaatgactcacctccatcattgtccaagttatctccacaaagcatttccatgacaacattgcagcctgtcccactccaacccacctgacacacacagtgccaaccattttgatccagggtacatcgtccatttccaaagcagagccctgggcagccatctgaaaagacatcagagagtaaccatcacagagacatcagaatgggattggccaacaatgatgtatttgcctatagggaagcatctaaccatctgggccccattcagatgaggtgttgaataaatggaagaggagcttgcttgcctgcaaaaccttcccagggaacttgttatcccttactctgcagtggttttccttagagagccaattaagctttattaatgctaaccccaattcccaacccctggttcatataggaagaaaactatggcaggggcaagaattctttttttcttttcactaaacatatctcctcatctcaatcaaaactatacggatgacactgtatctagttatggccaatatgttgggaaaagatagcagtccctatgaagagaaactttccctactacttctagtctgtgctgattttcccttatgatgtattgcttcaggacttaagtatgttggtatacagttcagaccacaccattaagtatttgttcatatggtgccttagaaatgtgctgtagttgctttatatttattcagcttttctcttcaagattattattcatctgcgggctaacgattgaaatctttacttccatggtatctctctcaaaagcttgcatgatattatgcttataacaataatattaaatgttaaataagtgtttatggaattaatacatgccagatctagactttctgaattatagagaactggaaaatatcaagtcaagaggaaagtgtagcatttaaataacttttatccattgataaagcattaacactgacaatggttcctctttagactttaaatttctcagggatgccctactctttgtacccgtagtctggagttcagctctagcaaagggtaacttcacatgcgccacatgcgcagtgggcagatgaatggagaaagcaactataatgctactgggtattttcctagtagcaacacaggaccagacgtgaattttactgggaatagcccagtcaatattcatttcggtttctttctttgaaagaaaattccaaaagcataaagagcaaaacaaaaaaaagattaaaaaatctgtagaagtaacccagtgttccttctaaatagttttccaagcaactatcaacagacaagaggaagaaaaaatttaaaaataaaatgacagatggttgttagaaaatatgaaaagcttgatgtacgtaatatactcatgacatggcatatgataaacatacataggtttgagaagggaatttttgtagttctattctaatggataggcaatagataattaaggtgaaataaagaataatttgggacatattaaacttctgaagctgaggtaatgaaaggcactaggatatctggcagaaaaacccttgctgtctctgttaaaggaagctccttggagggatggatgatgggatacttctaggaggataattctcctgcccctgtaaggacttaggagtccttgtatatggacttggagccatattgttatgttaaagagaaagttcatcttctgaaccaaattatttaataattattaaattattaaaaattatttaataattattaaattattaaaaattatttaataattacctgtgtaatacacacagatccagacacacacacatacacagaactcaatataaagacaagaaaaagtagtccttaaaactgcttatcagtccattctatactacgggaaaaagtgactctttgatgttgaaaaaacaaattaccttttagtgtgactattttagcatgaaactgacaacattatatttaaataagattgccaaaaataaaaacaaacaacacaaatgccaaaaaacgctaccctttctttcttacatgcatattttcttttaaaaatatatttctgttataaaattagtgagaaaaatcttacctcggacagcatctaagtagtgagctaaaagggaggggaaaagagtgatcaaatgaatttctgagagactaaagctatacaatatgtactaatggtttaccatctgttgcctgggaggagaacagcaaactgcgcactgctgaaatgcctgcagctcaaaagttgggtacatgggcctgtgtagtttgtgaataatattttctgtgagaacaatattaatggcatttctgcaagaaactctattaggcttcataaaaagtgtcatatttcattagaagtataagaactgcattttcacatttcagtaataactcctgtgaaagagcactggcttcaacttcttattagtaatatctttagaagagagttctggagtaaccacctatggtaatcatcacaatatttaaatcctcttatgtaaaggcaataaacttactgtagtacaggaatgtaattacttaagctacacatctgaatctcacccctctccacctttttaatgaatcttaaatatttcccacagttgcagaacaagacttactgtacctttagtagagaagtaatgcagtttatgaagattatatgttatatgtattatatatattatacattactttggcaagctccaaccattataacaaaatactttcacctaaaaatgaaagctgtagtatagtctagtgagggaaaagcctacaaacaataaattgggtatccagaggcccacatttgcctttgctctgcatgaattttctgtgtagtcaaggaatgccactggaacactctgtgaccccctttctttagctgaacaatgggaatcatacttgttactctgtattaatgacaacctttctatgcaaagatttcttgcatagaaaccttagcggtggatagaaatatatgttaagggctttgctttttttcagaaaaagaaagtgttttataactgaaatatttatttttaatatcttttatagtgtgaagatcacatgataaattaattattacataggcttttccatattcacagatcattttccctttgtgaaattagcaataaggggtgaagggagagtggtggcttcaggaccaactctctacactaccggataaacaattcaacacacatgttctattgatgataggtcagaagtgccttcctcatatacattaaagacagcctctaatgatatcgaatggcccctgttaaagtagtcccatttaatgaaattgcctctaagtgctttcaactgaaacaacctatacttttcaaaaggaaaaatgggcagagaatgttaccttcactacaaaagcacttttcttattaactaatgacaccttattccaatgtaacatctttcacttgagtaactcaaagcacttgaaagcagaaaacataaggaatactgaagtaataagaaaggaaataacacaagaaatacgtagaatgtcatcgacaaaagaagaaacctaccagttcacaaaactttaaaacttgtaaccaaccctccttctcctcccctactccaacctcaaattctactaaatgccttgtgattgactcactagactgctcttaacttcaactaatccaacttactttggttaaagtatggtggtacttaccaattgtgcagtggtcgccctcccatccagggctacactcacattttccatctttgcattggccatgctcagtacaatgagaatgacaggagcgttcctcacatgttggtcctacccagccttcttcacactggcaaattcctcttgagcagactccatggctaccacactccatggtacacagctctgtggggaattcaaagaagacatattaacatattttgttaaaaccagcatccattcttccaaaaaacattataattaccaaaaatccctgtctatatttatattttatttatttattattttaatagagatggggtcttgctgggttaaccaggctggtcttgaacttctggcctcaagtgatcctcccatcttggcttcccaaagtgctgggattacagatgtgagccaccatgccctgcccatacttatattttaaacaaaatgttaataaacaatttatataaacaagatgtcacaaagatctctagcatctgaatgaatgtgcaagaaactctaaaaagaggtagttaagtctctaagaataatataaaactctaagccaaactgattctgagaagtctataaaatgataatggcattcaaggcttagaaatgagattaatgacaaacaaatgccaagtgggtttcactaaaaattcattaagatcacagataatgttgcaggaattttatgatagtataaggtatcactgggggaaaaatcccaataaaacagtgccctaacttcattcagaaagacaagttcattaattggaaagataataactttctaataaaattcataatatacaaaaggtaaagatgccaatgatgacaaccagctggtttccctgatcatactaacaatatttgcatttattttaagcatataaaattaaccctggttgattaaagtacacatccttcttatcttcaaatgctactaagtatttagacagtataataatgatgatgtgtactggctctgctgagtttctttcctttgtccctttgactttttgttgagaaatgctgaatattaataaagtcatgacagtagataaaccaacataaaagcatggcaagcctctttcgtgatctaattcccttgctggaggaagagaagtaggataaaaacctacggaaagaatgaaatatgttttgggaacaataggccacatattcctgaaaggaaaagagggtgttctggaagccaggttgtctctttcacagtctcaaattctgaaactagtttaatatatttagaggcattgatattaatattctccacagatagcagagttatttttcagtagatgacaatattcttctgataaagccatgattatgagttttattataatctggatcaatttgttcatgggtttactcacaagtattctttgaaggtcagggtatgatgggaagagtagtaaatttgaaataaagataactgcatccttgattcctctgcttagtacctatggacccttaggcaacttactaacatattgtcttaatctctgtttgcgtaagaatgcaatagaagtaataatacttatacatcacaaagctgttggacagatttgaaatatagtttagagatgtaaccaacaggacttgctcaaaattggatataagggatgaaggaaagggaaaaataaaagtttggcttaaacaagtggatagataaagctgtcattaatgaaatgggaaaggctaagggaaaaataagggtggaagatcaaaaagattaaccctaagatatatgtaaaaagccaagtgaaaatgtcagtgcaaccagcagaatatatgattctgacaggccaggactggagatataaaattggccatcattagcatataggtggtatttaaaggcatggaaataactggttgatacctctaaacagggaatagaagagccctgaagaaagatcaggtagaaaaaaagaggaaccatcaaaggaaactgggatggagatggcagtgagtgataggaagaaatccaggagattgtggtgtaactaaagcacaagaggacacttttcaataaaggagtgtttaactacatctaatattgctgagaggtcaagtaaggcacgggcagagaagtgcccattggatttatcaacatggaattcgttgatgactttaggaagagctgtactgataaaggtgtagttgaaaagccaaattggaatgggtggaaaagtgaatggaaagctgtgcagggactcatcaggttgtgagaaaagtctagggcatagaaaaacgtatcttaaaaacgtgggccttggcttaaaaagtggtagctcaggtagaattatcccaaaagaacccctggtcccgaatcttggtctgaatctctgataatttgtatttataacttcagtccttgtagtaaggctgatattatcattctgttccccttcacggcctcctcccaagacattaaaaactgaactgaaagggcctttataagattaggtgctaattggttaaagctaatcaagtcagctctgcctagaatagttagaagcaaacatttttcatatattgctttgtacaactataaatcttaggcatagaggagtataacattctgatttctgtttgaaaagtaataggactagatgaacagtattggccaaatagcagagtaggctattttcaaactatctctatataaaccattagaaatgttggatataatgtaacaattttttaaattgcatgtcttggctcacaaaaaaagagaaatcttcaagtgccagaagcaaagaggatgctaaaagccaaagcagtcaatcctctggtagccttgagagttattatacccaattacgactaggggcttgggtacttaagtccacaaggaaaaaagagatgaggtcttggcaccatttcagatggagttggactaaatctccagcataaagttggagccacttgaaaggctgcaatcacagtaagatggtgagtaataaactgtacccactagcccagagagatgacaaagaagtactgactattgagtataaaataataataataaaaaatctggagctaggaaacaatgtagaaataaaatactatcgtttaataatatgtaagatggagtgtcctgaatgaaatatttggaaagccttatattattcgggagttaggtaactggtactttgtcaagtatgcatatgaaaacataaaggtggaattctgtttctagtaatagggacctaagtaatttttactattcccttctgatgagaactagaaaatctaaacaaaatatatttttaaatcttttgggagttagtggagttcacaaaacagtaaagaattactgtgccaagttccagaagaaaaagaaaacccagagagaagagcctgacatttatggatgcttttcctatagcagcatctgtcaattatactagagggagctagaaggctcagaggctgagtagagctttttcagtctcatggaatcagaaaaaaaaattgaattgataatggctaatacatttctaacattggccaggcacattggcatacacctgtaatcccagcactttggaagggtgaggtgggcaggtcacttgagcgcaggagtttgagaacagcctgtgcaacatagtgagactccatctctacaaaaaatacaaaaaatagctgggtgtggtggcatgtgcctacagctactcaagaagttgaggtgggaggattgcttgagcccaggaggtcgaggctgcagtgagccatgttcatgccactgcactctagcctgggcaacagagtgaggccctgtctcaaacaaacaaacaaacaaacaaaacccaacactgaagaaagcagtaagccaaataaatgaagcaaaattgaaagaagaagaaagggaaaaggacaaattcacaatcatagtcagagactttacagcccccctctcacaccaactgatagagcaagcaaacaaatcagaaagaatatgaaatatttgagcaacatggttaacagatttgatctaattgatacatacaaaacactgccataaatgactacaaaatacacataatgtatttcaaatgtatatagaacatttacaaatattgaccacgtgctaggctctaaagcaagtcttgatatatttagaagtattgaaatcatacataggatattttaagcccagtatgaaattaaatttgaaatttgtaatagcagatgaatctaagatccatacatgcttggaaatcaagaaatatactttcaaataaaacattaaacgaataagacatcatcatgaaaattagaaaagagatggaaatgaatgaaaatgtgtaatataactaaatccatgtgtacagaaaaatttataaggtagaaagaaaaacgagctgaaaaaccatgacctaagtatcgattcttagaaatcagaaaaagaaaaccaatgtatacaagaaagtagaaggaagaaaatgctaattataagagctgaaactaatacaataggaataaatatactacagaaagaatcaacaaagtcaatacttgatgattggctcagaccaataaaattgataaactcccggtggagactgatcaagatgaaaatacagaagacccagataaacagtatcgggaataaaaagtatgacattgctatacatagtacaaacataaaacatcctaagacaatattactaacagctttttgccaatacatctgaaattttttatgaacaaatttctagaataatacaacttaataaactacaagaaaaagtggaaactgaatagtttctttaaagaaacttaatccataatggaaaacattaccacaaagaaaattccagtctcagatgacttcatttgtaaatataccaaacttttaagaaagaaaaattgccaatcttaaataaacttttccaaaaaatagaaaagaggaaactcttaacaatatgccttatgaggtcaacataatcctgatataaaattctgaaggatattatttaaaaaatatatgacagtctttctcatgaagatctcattcatggatacaaaaatcctaaacaaaaattaacatagcaaatctagcattacataacaagaaataatatcatgaccaatttgtgcttattctaggaatatattataagattgctttcacatttgaaaattaacaaatgtaattcatcacatatatggaataaaagagaaaaatcaaattatcatctcaatagatacataataggtatttgataaaatactaaacatccatttatgataaaaacttgtagcaaactaagactaaaaggaaattttaagttaacttgtaattaaaaggaactttcaactttaattttaaaactaagactaaaaggaactttaaatttgataaagagtagctacaacaccccatagcaaacaccataatagtgagatgttaaaatctttttttgtgttattaagactgagaaaagatgcctatgatcatcatttctacacaatataattctggaggtcctagccaatgaaattatgcaagaaaaaggaaacttgtataaacactgaaaaggaataaataaagtcatcatcactcaaaggcagtacaactttaacttaatggacatatataggacctcaaagctatgactatacaatacatgttctttccaagcacacacagaataacccacaaaaactgacaaagattcatctacaaagcaagactcaataaatgccaaagattccacagcatatggattattctgcttcacaaaatgcagtaaaattagaaatcaataaacaaaaagataacaaaagaaaaatcccagaaaggtgttctttaaaaacacacttaaaaagaattcatgaattatgtttcaaaaattacattggaattagaaattgagtaacaatgaaatactatttacaaaaacttgtgggatgcagcttagacagtaacttagaggaaatttacagcctgaaatgcatgtagtagaaaagaagaagaattgaaatctaatgagcaaagtgtccaaatcaaggatttagaaaaaggactacatataagtagatgaaggacacaacaaagccaagagcagaagttaatgaaattggaaacaaagaaacaacagagaagatcaacaaaatcaaaatctgcatctttgagatgaatataaaaaatagagaaacccatggcaaggtaatagagctagaaaaaaggaaaagaaagaatacaaataaacattaaagattaaaattcaaaaataaattagagactgctattaacaactttatgcaagtaagtctgaaaccttagataaagtagatgtttttccagaaaacaaatggacgtgagaagaaatagaaaacctgagtacacattaaaaacattgaaaattgcccagatggttttacaggtgtattttgtcaaattttcaaaggacagataatctctattttaaactataccagagaacaggaaaaaagggaaaccatcttgaatcattttataagaatataatctagttccaaaacagttccaaaatagggtaagaaaaggagaaaatgattttttttttttttaaaggtgggatgtctctattttgcccagactggacttgaactcttgagcccaagtgattcttccaccccagcctcccaagtatctgggactgcaggtgtgttccaccttgtccagctctagaactgatttcttaataggccaatctcacttataaacatggctgcaaaaatcttcaagaaaatatctggtaatcaaaccaaaaatgcacacacatacacacacacatgcgtacaccagtatatagaagtcacagccaaataagcatgaatgctaggatggtttaactttagaaaaatctatcaatgtaattcaccactgaattattccattttactttcacacatttcataatgattaaagaaaaattataattttattattatatgtagaaagagtaccatttaaaatttagttcctatttatgatagaatctcctagaaaaacatggctaaaagatagcttactgagtatggtaaaggtgatttaccaaaatcctatagtaagcatcatatttagtacagaaacagagtaatatattccttttaatgtcagaagaagtactagaattaactacagcttctaactcaatgttgtattggaaatcttagtcagcacaaaaaggcaaccaaagacataaaaaattggaatgcctgaaaaggaagaggtaaaattgaacatacaggtaaactatgaaagctacaaggtttctggatgtaaaatcaaaaggaaaaaatcaatagcatgcctagatattggggacagcaaattagaacacgtactttttttttctaaataaaaggttccattaaaaataatagcacatatagcaaaaaaaaggttccatactcctttacataaaattttaaaactttattgaagaacacataaaaagacccaatcaatggaaagatatactgtgttcatggctcacaaggcttaatatcattagaatgtcaatttttctgtactagctctataaattcaatgtaattctggtaaatatcccatcatagagcttgaaacatgatcctaaaatctatatgaaacagaaaaggccaagaatatccaagaacattttgaagcatacctattaatactagggggtgtgtatgtctgtctgaacctaaatatccatcaatgggaaaggatatataaattttagtatatttatgcagtgcaaaaaatatagcagttaacttgaataaggtagagatccatgcctgaatatggataaactttagaaacataatgatgaaggaggaaagcaagttattcatatgaaatttaaacacatgtagaaaaatacattttatggatatatacatatttggaaaagcctaaacatgtgtattgtatgacaatgaatagactgaggatagtggtttctgctgcagagaagagaggcagatgggatcacaaaagtatacatagggactttgtttgtatttattaatttttaaagcaaagtagtgggtttacagctgttcattatgttatcttacatgtctgaaatatttcataataatttacaaaagaaaaagagaatcagtaaaaaacaactgtctttagaactgactgttctattgaataaataactggagatattacttaacctaactcttacacaataccctccacagatacaaaccacaaccacgagtcggataggattcagcacagtaagaatccaggtgggaagcaatatcctcatgaatgagggaatcctctacaaaatgaattactacaaatggagaagcagatcttaagcaataagcattcctcattttgaactgcatcaacatttctgcaattgcatccagttccaaatagagtttctggactgattctaagatgtttttcaatcccaatcttcctataatcagcagtggggttggtgtgggtgaagaactaacagaaaacagatgctggcaattgtataatttataaacaagatagaaatgatatttgctctaatacatttgtctcatgaatagttctatttcctgtgtaatattttctatcttgttgaaaatacattaacattacaggctacaaaatatgacaaaagaatgctaaaatataaacattcttctgtgcaaatgtattggaaaagaacatgaaaaatataggcagacactttaaagttctattgagacatttcatttttaataagtttctttatgcatgtcaacaatgaacaacacttgtataaattgaactcagatacaactggaacacttctttgttgcatgctgacaaagaacaatttgattaaacagtaaatccttcagagcctccctcagaaccacttctctgagatttactttttaggcaaaagtttctagtaatgtaaactctgttattcttgacccctctgccttctccaatattagatggtgatcatatttggcaccccaaaagattaaatctggttatcagtttctaaagtatacatttatgtaaaaatttcaagattaaaatatggcattctaaacaaggaaaagacacctctgatgtaaaaattcataaaaattaagaaattattacatattcacttgcccagcatctggtagaatcaattaaagatcagagtaaattaggctgaaagggaaagcacagggaagaacagagaatgaatgagcctgaatagacagagaccctctctttcttagactttactgcaatttttgttggggaaactaaactatgaggatttttctcattgttttgtatgattaatattagaaataacagtaagaaaaaaaagtaaggttatattggcaagtgtaggcagtgccagctcaagctgtttgtttaagggctgaaaaaaattttggtgtacaccaaaaatttcactaaaatcaagcaatgattcaactaataacagtaaacattattacaaacaaaagtttgtgtactgtgtgttgtttcaccaagtatttggatcattttcattttactgatttcaactccttccatttctcagtagtaaatattctactagaaagtaggactactataagtcactgttaactttatatcagtagaacacacgtgcacacatgcatgcacatgcacacatatatacatgcatgcacacacatatttttggtgtctatttctctaaaagtaattagaagaacatattagttgatgaggtatcatatctgttttattgcatatggttaaattaaataccatctctaaccaatctttacaagtaccttgctatgataaagatttggctttactgtgggataagtatcacgttttctatgcttgaagtataatagtatctcctcattttaacacagaaaacctataacataatacttgtccctcagcctcagctttacaatgatgcttcaatgtatcttagtagttttaatactatcttaaatctgaacaattaaactgaagagattcaaaatgatacaaaatgtcagctagctttaactgaacaaatagcaacatacaagcagcataacaacagcgacacactccagcctatataaaaccttgagaggattctcaaattcttgatggataagaacaaaaatcccaaggaatctagcatgtgaagatcaaaagttgtaatgactttgagcttaatgtttcatggatcttgactgtcacatggttttggatttcctttataaaggaactggttaactgttctttggtaggtctgaataacctgacaagacagaaaaatccatgcctgacttacaacttttgaattcgataaaataagtcagttggccttttcactatacagaatctttcctttggaataaatcctgtttccttgcttgctaaataaaatattctccctaactctagatgtcacattttggttagcttagtgatcagaagctcaaactattgaagatgaggtgaacttctactcatttgtagctacagactgcaagagcatgtttcaatcctttgattataaacctgacacttttgcctatccaaatagtatcctcaaatgccaaagaatgttgaaatctagacatttgcttatcatttgacccattaggtaccagattgtcagggtaaaacccaaccctaaaggagcaaatattaactttttttttttgagacggagtcgcactctgtcacccaggctggagtgcagtggtgtgatctcgactcactgcaacctccacttcctgggttcaagtgattctcctgcctcagtctcctgagtagctaagactacaggtacacaccaccatacccagaaaatttttgtatttttagtagagacggggttttgccatgttggccaggccggtctcgaactcctgatctcaggtgatccacctgcctcggcctcccaaaatgctgggattataggcatgagccactgtgcccagccccgcaaatattaacttttaaggctcatgatctgtcatgagtggtaggccatgggattgctcagccatggcagagtttgtttttggtttatctacagcttttcacttagactttcttatcataattgccgtctaggtgcagtttgtgaccacctaaaagggcaagcttaactgcctcacagaggcatgaaatgcatgtcttagacatcagtaaaacagtgctctcacttataaaactatatacactatatagtgtatatcatttataaaactactactggaacaattatactgcatcttgtctaagagtggctacttaagaactatttcttggtaagttagaaagctacttttcgtatataaagtttaacattcttgggcataatttggtaaaaatgttaaaattgcaccaggcagaattttttctcccttttatgaatgatatttgacctgctttccctttttcagaaaattctgacattagctctcctcaaaatgaatttttgttagtccccttaatgcacatctaaattacctacatggtgttattctaaggcaataagcctcccaacttagcaaagaaactctacaaaccaaagatcttcaaatacacgtctaagtccccaagcaaatctgatagcatacttcagtggcaaagccaaagctgtatgctggaagaacacttcacgaagactaaaagtcttactctaaatgagaaagagctcacagacttgtcttccccatcccattcaacactattgctaagggctcaccatgctttagaacgctaactctaactggagtccacaagagagacgatactagcaatcatcaggcaacctttgcaacggtggtaggcttctgcatcctgaatgcagaaggtgtgttcaaggcattacaaaggcatggaaagcagctttctgtcaaagacctgggcaggggctgcatacatatttacaaagctgccatcatagcccaacagaccatgcaccaacagtttatttttacccttataaataagcatgacaggggagaaaagaaacgtaaagaacccagagtcaacaaaatcctcagcatgatgaagaaaaaaggcatataaatgtccttatatagtatttcaatgcatagtttagtgtcatttaagacatttagttttaaaaaaatttatagttttactctatggcaatcatcaaggctctatggttattagtgtcatctgaactttaagacatatattttgtcttaagacatatgtttcctatgagtcgccacacccattcttctaaggattaataatggagtaaagtatttgactttatgtctatccttgtcttatgctatcgacattctagtgaggttacaatgtactgtaggaaagctatgaggaggtagtatatcaatctaggtacatttacacgaagttaaagtccttggctcactctcaatttcacaaataacatgcatgctacgcatttctacctggctaagccaccggcacctttaaactcaacatgtttataacctacattttaatctcgactcatgaatcagttctttatcctgatttcactattttttttttttttgaggcagggtctcactccgttgcccaggctggagtgcagtggctagatcatggctcacggtggcgttaacctctcaggctcaagcaatcctcccgcctcagcctcctgagcagctggaactacagacacatgccaccatgcccagctaattaaaaaaaattttctgtagagattgggtctcactatgttgcccaggctggtcttgaactcctgggctcaagcaatcttcctgccttggcttcccaagtagctgggattacatgaatgagccaccacatccagtctgattttactatttttgttaatatcgtgataatagtcctagtttccaaggttaggatatttggcattacgctttcattttccttttgccttatgctcatatccaactacatctttcagttcttctgttttcaacacttcttcaatttctctctctctggaaggccaggatagcatagtgattaagagtacggactctaaagcctgatttcctggtctcgaatcctagctcagagatcgattaactatgggaccctgagcatctcactaaatctttctatgctttggtttcccatctataaaatcgggttggtacaaggaacaaatgagtcaatatatgtaaagtgcttacatatattacatatagtgctgggtacataagtattacataactgttagaaattatgactgcctctgtttccaatacacttatctggcccttcaccatcttttgtcttgagtctcacaaaagcctcctcatcggcttcacaaatgctctgttctctttttaaacatcccacatacaactataagctagaacaacagaatcttagggcttgggaaaactttaaaattcatctggccagcccctcactttgacatacaaacttcctacctttccaatattttcccaaaagttcagctatacgtcacaaagccagtcaattctatatttacgcagccatattagaaagtaatttgttgatttgaactgaaatctgctgtccatcttctttcaccaattagatttatttgtgtcctttaattctgccaaaaattatcatactctcttttctactggtcagcctctcagatcattgaagatagctatttaatctcaattaaatttttcttcatctagccacccttgagtcctacaaatgttgctcatgttacattgtttgcttacccttaacatattggttactcttctctgcacaaagcacagctctggtcacacactacatataaaaatatttcatagttcaccaaagcacactgaagtccaaaatccttagcctagaaatctaaactctctctaaccaagccccaattgttacttttttgactttggttttcacggttctccagcttgcatcctttgctacagacaaatttgactgctagccctattctatttagtagaatcaccttcttttcatgctttggggctctacaatgttttccctttctttttcaaggcctttcccacagcctatctctacctgcacaaatgatttttccacttgaagcttgaatgacaccttcttcaggcaacagtccatggtctaagatgctccaaggcagggatgaccttctcctcttctatactattatagagttttgtttacacatatattatgattgttattgcataccatcttttattgtagtttttatacatatgcattattcttcccactatattgtaagttgatgaaggcaggaactaggtcttaatcctttttttctctttcacacatttctagcacataagcactcaataaatatctgtaggattatttcatgaattgatttaacaaacatttattgagtactctgcatagctcagggcaaacttgagctttatatactttgattaaataaattactgatgaacataaaagtatctgaaattttcagtctgagtgactagaaaaatgttggcatcattgagggaaaccaggaagtcaggatgagttatgtttggttttggttgtgtttaattcaaggtgctggcaaaagatgcagaatgataggtatttgctaagctggcatatggataggcatttactaagctaagattctattattggagcttacagttgtgtgtgggaaagctgcatgctaggtgctaatgtggatcaaaaaagaggcaggaaagagggtggtgctaattcatcggcacttgtctgagattaacattaaatcaaagtaacgacataaaaaatagtggctacaatgtaaggaaacactgtcagtgtccattgacagacaaatggataaagaaaatgtagtatatatacaataaaatactattcaaccttaaaaaagaaggagatcctgccatttgctacacatgtgtgaacctggaggatgttacgctaagtggaataagccatgtgctgaaaggtaaatactctatgatctcacttatatgtggaatcttatatatatatatgtatatatacacatatacatatatacacatacatatagatatacatgtatatatgtatgtgaatatatactcatatatgtctatatacacatgtgtgtgtatatatatgcacacacacatacacacagagttagggaataaaatagtggttatggagtggggttggggagaggaaatgggaagatacaggttaaaggacacaaagtagcagatatgcaggatgaacaagtctagagatttaatgtacaacatgaggaccatagttaatataattgtactgtattaataattttttattttttatttcattaaaaagtttttttaccttttattttagattcaggaggtacacatgcaggtttgttacctaagtacattgcataatgccgaggtttggggtatgaatgatcctgtaatccaggcactgagcatactacccaacagctagttttcaacccttctccctctcttcctccccctatagtagttcccagtgtcttttgttgccatctttatgtccctgagtattcaatgtttggctcccacttataagcaagaacatgcagtatttggtttttctttcctgtgttagtttgcttaggataatggcctccagttccatccgtgtggctacaaagaacaatacttagttcttttttttttttttttttttttgaggtggagtcttgctctgtcacccaggctggagtgcagtggcacaatctcagctcactgcaacctccacctcccgagttccagggattctcctgcatcagtctcctgagtagctgggattacaggtgcgtgccaccacgtccggctaatttttttgtatttttagtagagacagggtttcaccatgttaggtaggatggtctccatctcctcacctggtgatccacccaccccaacctcccaaagtgctgggattacaggcatgagccactgcacccggcctatttagttctttttttatggctacatagtattccatggtacatatgtaccacattttctttatccaagcctccattgataggcatctaagtgatctcaagtctctgttactgtgagtagtgctgtgatgaacatgcaagtggatgtgtctttttggtagaacaatttgttttcttttgtatatatccccagtaatgggactgcttgattgaatggtagttttgttttaacttctttaagaaatctccaagttgctttccacagtggttgaactaattttcactcccaccaacagtggataagtgttcctttttcttcacagcctcactagcatctgttattttttttaactttttcatagcagccattctgacttaggtgagatggtatctcactgtggttttgatttccatttcgctgatgattaatgatgtggagcattttttcatatgtttgttggctacttgtatgtcttctttagagaagtgtctattcatatcttttgcccttttttttaaaaagcattattttattttaagttccgggatgcatgtgtgggatgcgcagatttgttacataggtaaacagtgccatggtggtttactgcacctatcaacccatcacctaggtattaagccccacatgcattagctatttttcctgatgatctcccttccccacaccccaatagtccccagtgtgtgttgttcccccccatgtccatgtgttctcattgttcagctaccacttatgtataagaacatgcagtatttggttttctgttcctgtgttagtttgctgaggataatggctcccaactccatccatgcccctgcaaaggacatgatctcattcttttttaaggctgcatagtattccatggtgtgtatgtaccatattttctttatccagtctatcattaatgttttttgtcaattttaatgggattatttgttttttccttgttcaattgaatcaatggattcttccaatctatgagcatggaatgtttttccatttgtttgtgttatctatgatttatcggagcagtgttttgaagttctccttgtagagatctttcacctccttggttagatgtattcttaagtattttatttttttgtggctactataaatgggattgtattcttgatttggctctcagcttgaacattattggtatatagaaatgctacttattgaggtggaacagctccggtctacagctcccagcgtgagcgacacagaagatgggtgatttctgcatttccatctgagatactgggttcatctcactagggagtgccagacagtgggcgcaggacagtgggtgcagcacaccgtgtgcgagctgaagcagggcgaggcattgcctcactcgggaagtgcaaggggtcagggagttccctttcctagtcaaagaaaggggtgaatcggcacctggaaaatcgggtcactcccaccctaatactgtgcttttctgacaggcttaaaaaacggcacaccaggagattatatcccgcacctggcttcgagggtcctacgcccacggagtctcgctgattgctagcacagcagtctgagatcaaattgcaagactgcagcgacgctgggggaggggcacccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagaccagtggttctcccagcacgcagctggagatctgagaacgggcagactgcctcctcaggtgggtccctgacccctgacccccgagcagcctaactgggaggcaccccccagtaggggcagactgacatctcacacggccgggtactcctctgagacaaaacttccagaggaatgatcagacagcaccattcacggttcatgaaaatccactgttctgcagccactgctgctggtacccaggcaaacagggtctggagtggacctctagcaaactccaacagacatgcagctgagggtcctgtctgttagaaggaaaactaacaaccagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaatgcagctcctcaccagcaacggaacaaagctggatggagaatgactttgacgagttgagagaagaaggcttcagacgatcaaactactccgagctacaggaggaaattaaaaccaaaggcaaagaagttgaaaactttgaaaaaaatttagaagaatgtgtaactagaataaccaatacagagaagtgcttaaaggagctgatggagctgaaaccaaggctcgagaactacgtgaagaatgcagaagcctcaggagctgatgcgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgacggggagaatggaaccaagttggaaaatgctctgcaggatattatccaggagaacttcccaaatctagcaaggcaggccaacattcagattcaggaaatacagagaatggcacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttagagaaaagaatttttaacccagaatttcatatccagcaaaactaagcttcataagtgaaggagaaataaaatactttacagacaagcaaatgctgagagattttgtcaccaccaggcctgccctaaaagagctcctgaaggaagcactaaacatggaaaggaacaactggcaccagccactgcaaaatcaagccaaaacgtaaagaccatcaaggctaggaagaaaccgcatcaactaaagagcaaaataaccagctaacatcataatgacaggatcaaattcacacataacaatattaaccttaaatgtaaatgggctaaatgctccaattaaaagacacagactggcaaattggataaagagtcaagatccatcggtgtgctttattcaggaaacccatctcatgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagggctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaagcatacccaggaattgaactcagctctgcaccaagcagacttaatagacatctacagaactctccaccccaaatcaacagaatatacattttgttcagcaccacaccacacctattccaaaattgatcacatagttggaagtaaagctctcctcagcaaatgtaaaagatcagaaattataacaaactgtctctcagaccacagtgccatcaaactagaactcaggattaagaaactcactcaaaaccgctcaactacatggaaactgaacaacctgctcctgaatgactactgggtacataacgaaatgaaggcagaaataaagatgttctttgaaaccaaccagaacaaagacacaacataccagaatctctgggacacattcaaagcagtgtgtagatggaaatttatagcactaaatgcccacaagagaaagcaggaaagatctaaaattgacaccctaacatcacaattaaaagaactagaaaagcaagagcaaacacattcaaaagctagcagaaggcaagaaataactaaaattagagcagaactgaaggaaatagagacacaaaaaacccttcaaaaaattaatgaatccaggagctggttttttgaaaggatcaacaaaactgatagaccgctagccagactaataaagaagaaaagacagaataatcaaatatacgcaataaaaaatgacaaacgggatatcaccaccgatcccacagaaatacaaactaccatcagggaatactacagatacctctacacaaataaactagaaaatctagaagagatggataaattcctcgacacatacaccctcccaagactaaaccaggaagaaggtgactctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagacacacaacagaaaaagagaattttagaccaatatccttgatgaatattgatgcaaaaatcctcaataaaatactggcaaaccgaatccagcagcacatcaaaaagcttatccaccatgatcaagtgggcttcatccctgggatgcaaggctggttcaatatacgcaaatcaagaaatgtaatccagcatataaacagaaccaaagacaaaaaccacatgattatctcaatagatgcagaaaaggcctttgacaaaattcaacaacgcttcatgctaaaatctctcaataaactaggtgttgatgggacctatctcaaaataataagagctatctatgacaaacccacagccaatatcatactgaatgggcaaaaactggaagcattccctttgaaaactggcacaagagagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatccatgtacaaaaatcacaagcattcttatacaccaataacagacaaacagagagccaaatcatgagtgaactcccattcacaattgcttcaaagagaataaaataccttggaatccaacctacaaaggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacacaattggaaaaaactactttaaagttcatatggaaccaaaaaagagcccgcattgccaagtcaatcctaagccaaatgaacaaagctggaggcatcatgctacctgacttcaaactatactacaaggctacagtaaccaaaacagcatggtactggtaccaaaacagagatattgaccaatggaacagaatagagccctcagaaataatgccacatatctacaactatctgatctttgacaaacctgagaaaaacaagcaatggggaaaggattccctatttaataaatggtgctgggaaaactggctagccatatggagaaagctgaaactggatcccttccttacaccttatacaaaaactaattcaagatggattaaagacttaaacgttagacctaaaaccataaaaaccctagaagaaaacctaggcattaccattcaggacataggcatgggcaaggacttcatgtctaaaacaccaaaagcaatagcaacaaaagccaaaattgacaaatgggatctaattaaactaaggagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaacagccccatcaaaaagtgggcgaaggacatgaacagacacttctcaaaagaagacatttatgcagccaaaagacacatgaaaaaatgctcaccatcactggctatcagagaaatgcaaatcaaaaccacaatgagataccatctcacaccagttagaatggcaatcactaaaaagtcaggaaacaaccggtgttggagaggatgtggagaaataggaacacttttacactgttggtgggactgtaaactagttcaaccattgtggaagttagtgtagcgatttcctcggggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaaaaaaatgtggcacatatatgccatggaatactatgcagccataaaaaaggatgagttcatgtcctttgtagggacgtggatgaaattggaaatcatcattctcagtaaactacagcaaggacaaaaaaaccaaacactgcatattctcactcataggtgggaattgaacaatgagaacacatggacacaggaaggggaacatcacactctggggactgttgtggggtggggggagtggggagggatagctttaggagatatacctaatgctaaatgacgagttaatgggtgcagcacaccagcatggcacatgtatacatatgtaactaacctgcacattgtacacatgtaccctaaaacttaaagtataataataataaaataaaaataaaaaaagaaatgctatttatttttgtacattgatctgtgtatcctgaaactttactgaagtcctgtatcagttccaggagccttttggcagagtctttagggttttctaggtatagaatgataacatccatgaagacagatagtctgagttcctctcttcctatttggatgccttttatttctttctcttgcctaattgctgtggctagcacttatagtactatgttaaataggagtggtgagagtgggcatccttgtcttgttacagtcctcaaggggaatgcttccagtttttgcctgttcagtatgatgttggctgtgagtttgtcacagatcgcttttattattctgatgtatgttcctttgatgcctagtttcttgagggtttttttttttttatcatgaaggtattttggagtttataaaaagctttttccacatctattgagatggtcatatgacttttgtttttaagatgaatcacatctattgatttgtatatgttgaatcactcttacgtcccagggatgaagcctacttgattgtggtgcactagctttttgatgtactgatggattcagtttgctagtattttgttgggaatttttgcatctatgttcaacagggatactggcctgtagtttgttgttgttgttgttgttgttgttgttgttgttgttgtatctttgccaggttttggtaccagggtgatgttgccttcatagaattagttagggaggagtcactttcctcgattttttggaatagtttcagtagaattggtaccagctcttctttgtacactggtagaatttggctgtgaatccatctgtttggggctcttctggttgctagagtttttattactacttcaattttggaacttgatattcatctgttcaggctttcaatttcttccttgttcagtcttgggaggttatgtttttccagtaatgtatccatttcctctagactttctagtttgtgtgagtagaagtgttaataatagtctctgaggatcttttgtatttctatgggattggttgtaatgttatctttgttatttctgattgtgcttatttggctcttctcccttttttattttttaatctagctagtggtgtatccatcttttttatcctttcaaataactaacttttggttttgttaattctttgcttggatttttgagtttaatttattcagttctgctctggttttagtcatttattttcttctggttgctttggggctagtttgttcttgttttctatttcctctaggtgtgaagttagatcattaatttgagatgtaactttttgaggtagccattcagcgctataaactttcctcttaacatagcttttgctgcatcttagagatttgggtatgtcctgtctctgctttcatttatttcaaaaattttttttaaatttctgctttaatttcattgtttacacaaaagtcattcaggagcaagttgtttaactttgacataactgtgcagttttgagagatcttctcagtatcagcccaaaatctccttaagctgataagcaacttcagcaaagtctcaggatacaaaatcaatgtacaaaaatcacaagcattcttatacaccaacaacatacaaacagagagccaaatcatgagtgaactcccattcacaattgcttcaaagagaataaaatacctaggaatccaacttacaagggatgtgaaggacctcttcaaggagaacgacaaaccactgctcaaggaaataaaagaggatacaaacaaatggaagaacattccatgctcatgggtaggaagaatcaatatcgtgaaaatggccatactgcccaaggtaatttgatttctatttttattccactgtggtccaagagtatggtggtatgattgcaatttttctgaatttattgagatttactttaaggctgagcatatgtttcctcttggagtatgttccatgtgcagatgagaagaatgaattttgtgtttttgatgggtagagtattctgtagatgtctactaggtccaattggttgagtgtctaagctaagttcagaatttgttagttttctgtctcaattatctgtttaatgttgtcagtggggtgttgaagaaccatactattattgtgtagctgcctaagtcttttaataattctagaagtacttgttttatgaatctgggtgccccaatgttgggtgtgtgtatatttatgatagttaagtcttgctgaattggaccctttatcattatgtaatgaccttcattgtctttatttactgtcgttggcttaaagtctgttttatctgatataagaatagtgacccctgctcttttttgttttctatttgcatggtagatctttctccaacccttaactttgagcttctgggtgtcattatgtgtgagatgagtctcttaaagatagcagatggatgggtcttgtttttttatccaacttgtgactctgtgtcttttaagtgggggcatgtagaccatttatattcaaggtaaatattgacatgtgaggttttgatcctatcctgaagttgttaactggttgctttgtagtttctattgtgtacttgctttatagggtatgtgggctatgtactggagggtgtttgtgtggcagcaggtattgttctttcattgctgtgttccttaaggagctcttttaaggctggtctagtggtaacacattccctcagtgcttgcttgtctggaaaagtttttatttctccttcacttatgaagcatagttttgtgggatatgaaattattggttggaatttcttttctttaagaatgctgaaaacaggcccctaatctctcctggcttgtaaggtttctgctgataagtctactgttagcttgatggagttctctatgtaagtaatctgaccttttactctggctgcttttaagatttttttctttagcactgatcttggatagtctgcggactacatgcattggtgatgttcattctgtatagtatttctcaagtgttttctgcttttcttatatctggatataaacctttctagcaagattaaagaaatatttttgaattattccctcaaatgttttccaggtttttgctttttctcctcctctcccagaatgccaaaaattcacattttggttgctatatataatcccatatttctcaaatactttgttcatttttttatcattcttttttatttattttgtcagactggcatagttcaaaagactggtctccaagcttggaaattctttcttcggcttggtctagtctattaataaagctttcaattgtatttgaatttcaactgtattttgaaattacttgagtgtgttttcaattccagaagctttgattgatttctgtttagcatattaatctcttcctttatttcctggattgctttagaagtttctttgtgttgattttcaaccttgtcttggatctcattgagcttctttgtaattgtgctttgaattctttacctgtaatttctgaatttctgttttggttaggaaccattgctggacttgctagtgtgatcctttgaagctgtcgctacattcagattttcatggtgccaaaactcttgtgctggttccttctcatctggagatgttggcacttctaatttttgtaattatttccttgccagtaggttttttcttcatcattctttacctataatattattggtttttttttttttttttttgagacagagtattgctctgtcacccaggctagagtgtagtagtacaatctcagttcactgcaatctctgcctcccaggttcaagctattctcctgcctcagcctcctgaatagctgagactacaggtgtgtgccactacgtccagctaatttttatatttttagtagagatgcggtttcctatgttggccaggctggtcttgaactcttgacctcaggcgatctgctccccaccccaccgatccccttggcctcccaaagtgctgggattataggcgtgagccaccatgcccaggccttactgtttttttttttttttttggtttgtttaatttccctttccttttctccccctccctagggggtgtgactgcagagaatgctgggtatgggctgtcttttggctttgcttctatagttctatgcacttctcttagcaggttttatagttagacctacaagccagtagatggtgcttgtaggtaagagctagctagctacagctaatgtggctgcatatatatttcatccttgtttactggtagaaactctctgttctctcaggcaatggactgattcatgcagtgcagagtgctctgaactctgctcagccctagggttgtgggggacaagatgaatggggccagactaggcaggtccacctacagatcttccaatgtcaggcacaagcaccagtgccaagtgataatccagtgggcagccaccaggtgaataggtgctttgaatgcctggagatctccctgggcatgcagcagagagggcctccctgcaccaagatctctgcacaggaaggatggggcaggtcaggatgccaatccaggtgagttggtgctccaaatgcctggagatctgcctgggcttggagtagagagagcctcactacaccatgatctgtgcccagaaagggtgcagcagctcatggtgctgaaccaggcaaacagttgctttgaatgcctggagatttgccttggtgtggagcggaaggggccctgcggcacctcaatttatgtccgtgaagggtgaggcggctcaggctgctagtctaggcaagcaggtgctctaaatgcctagatttctgcctgggcatggggcagagagggccctactggaccaaaatctatgtccaggaagggtggagcagctcaggcttctggtccaagtaagtgaatgttctaagtacctgaatttctgcctggggtggagtggagagggctctgctgcaccatgacctcaggggagcaggctggggcacttagcaatggcatacacagaccagatgcaggttgccaagctggccctggctgcaaatctcacttcccaagggaaactgcagttctcctaccaatccgggattgcagtcggggagagcacaattccagtgccttctgctgaggtgctttccgtagttctggctgtggaggcccctaccctactccagagcaggtgctccaatctctggcctgaggctaaaatgcttgtgtggccacacttctaggttgccaagcaatggctgattttgtatgcacccagattaaaaatggcatctggctctcattcttgggtctgggaaaatatctgcagcttttcctggtatctttctctcacagcatctccaagcctctttctaagttagctctagggcttgggcaaaacaaagtgctttcccttggcctaggttgttcagatccactgtggaaaagtgagtcacagagggaagctctctgcccccttgtgtacttgggcttcactcacttttatcagctggatgacatcataggggctgtttgccagcattcacctccctgggatctggagtgtccttcacaattcccagaataatgcttttttaacttaaaaaaaatcttctcatgtcagaggagagtggaccccaggctgggagagaaatgtcttagtcaccttgggttgcaatagccaaatgccatagagtgggtggctgaaacagcagaaatttatttctgacaattctgaaggctaaagtccaagatcaaggtgcaacatggtcaggttctggtgaggtccctcttccagattgtggatggctgacttctcactgggtcctccaggatttttttaaatagatagattttagctgctcttgtcacaaaaagtaacatgagatgatagatattttaatttctttcacgatagtaaccattctactatctatgtgcatcccataatatcatgttataaacctcaaatatatacaataaaattattacgtagtccacaaaactaatgactatgaacaaagtcaatcttttctcatgtacttggaaaactcctaaatttctctgtttgatactcaaaagtaaacatttgaatctctgttttcattcatatctccattcagtgaggacttctatagaatcactggtttgaaaggcctagaatgtcaggatagttaattctttttgaggcttcaaaggtcagttctcacacgttataacctcctggccacttgcaatctatcaataaacacagacaaatgtccttgctcttttgaaggacaaaagtgttgtactcctttgtggtttggtttctaacttttaagagcaccaagagcagtccaaattcaaaggaaagaagcagcttcctcccactctgttgtcaattatcttcttgggaagtttctttgcagagtttttgtgcatctctgagccaattaccacaagaaaacaaaatgacctttaaattaaagcaatatgagtatgcttgaaatttgcagtgagaatagatcttaagtgtttttgccacatacacacacacacaaaagtaactatgtgaggtgatggatgagttaattaacttgattgtggtaataacttcacaatgcatatgtataaaatcatcactgtgtacatcttaaatgtatacaattttatttgttaattatgtctcaacaaagctagagtaaaaaagaagaaaggaaacaatctgaaatgcaaatgattgactaataatttccaattatgtaaaatattcttttgtaagaaatatgaatactcacttgacaattgtagactatagccacaaataaaaacaaatatattgatcatttatattaaaaatgaaaatatacccttaatctttttcttcttagcatctaagttcagactgtggtttacttggtcggctcttataaaaagaaataaaagccaaaactcttatttaggttttaatacattcaaccacatttcagattttccttaacaagcctaaatattaaaacagcttttaaagatgagtatataaaataaatcatctttatcatgaaagcactccgattatactttccttgcatttttaaatgatgacccttttagaattatccaaaccctgtaactgtcacattcttaactttccacttttttaataaaaatgatttccataaagattagaaattaatctgacctgactctgaaaactaatatagtttagcacgggaagctgtaaaaattcacctatctaggtttaataaagaaagttttttcaatttaaatatgcattgcatttaataagcttgcatgataatttcaacaatgttcatgggttctttaaattaccttcctgctgtgtccaggaaacaatccaattttatttttaagcaactgaattaagaaaagctttcaaaatcacaaagcgatttctgaatgacacaaaatgtaatgattagaagccagccaatcagattgctctgatggctgacttaagagaaaaaaaaattgtttgcctatatttctgtaaaccccaaatatatgagtttttggatacacctaaatgtttgactcttagatatcttctatccaaacatttgtcattgtgaggatcagcattccatccttttttccttccttttgacttttcattcacacgagttaaacatggtgctaactggcagaatacaacaacaaagacagatatggcccctgcctttatggagcatggaatctattgcatacatactcaaagaaatgtggaactacaaattgagaaaagtactatgaaggagcaatgcagagtgcaatgggagactgtcacagggtgacctaatttaatttgaaggtgtcaggattttgaccatttttaggcattggcatttaagttgaaaactacaggatgaatgggcaaacgtatgtggcgatggggaaatgaaatagataatatgtgtcgtaaggagagtaagagagagaggcagaatgaatggtatgagatggggctggacaagcagaggtcagagaattcaggcctttgtaggccttgctaaaattttggactttattatagtagcaattgaaaaaccctgaaaggtagtagagagtaacaaaaatcatatttgccttagaaagatctctttggatataatatagagaatggagtagaaggaagaagaggatatataagtggccaaaaaacatatgaaaaaatgctcaacatcactaatgacaagggaaatgcaaatcaaaaccacaatgtaataccaccttactcctgcaagaatggccataattttaaaaatcaaaaatatcatagatattggcatagatgtagtgaaaaggaacccttttacactgctggtgggaatgtaaagtagtacaaccctatggaaaacagtgtgtagattccttaaagaactaaaagtagatgtaccatttgatccagcaatcccactcctggatatctacccagaagaaaagatgtcattatatggaaaaagacacttgcacatgcatgttgatagtagcacaatgtgcaattgcaaaaatatggaaccagcccaaatgtccatcaatcaacaagaggataaagcaaatgtggtatataaataccatggaataatactcagccataaaaaggaacaaagtaatgtcattcacagcaacctggatggaggtggagaccattattctaagtgaagtaactcaggaatggaaaaccgaacattgcatgttctcttataagtgggagctaagatatgaggatgcaaacgcacaagaatgatataacggagtatggggacttgaggggaagggtgggagagggatagaggatggaagatgggtgataaaagactacacattgggtacagtgtacactgcttgggtgacgagtgcaccaaaatatcagaaatcaccgctaaagaacttatccatgtaaccaaacaccacctcctccccccaaacctattgaaataagaaaaagaaccctatctctcaccatgtacaaagatcaaatcaaaatggattagagacttaaatctaagacctcaaactatgaaactactacaagacataattgggggaaatctgcaggacattgatttgggcaaaaagttgttgaataataccccacaagcataggcaaccaaagcaaaaatggacaaatggaatgacataaagttaaaaagcttctgcacaggaaagaaaacaatcaacaaagtgaagaaacaacccacagaatgggagaaaatatttgcaaagtactcatctcacaagggattaataaccagaatatataaggagctcaaacaactctataggataaaacctaataatctgatcaaaagatgggcaaaatatttgaatagacatgtctcaaaagaagacatacaaatggcaaccaggtatatgaaaaggtactcaacatcacttatcatcagagaaatgcaaatcaaaactgtaatgagaaatcatctaaccccagttaaaatggcatacatccaaagacagttattacaaatgctagtgaggatatggacaaaagggaaccctagcacactgttggtgggaaggtaaattagtacaaccactatggagaacagttttgagaacagtcagtttttataaaactaaaaatggagctaccatatgatccaggaatcccactgctggatatatatcccaaagaaaggaaatgagtatatcaaagagaaatctgcacccctatgtttgttgcagcactgttcacaatagctaagatttggaagcaacctaagttgtccatcaacagatgaatggataaagaaaatgtggtacatatacacaatggagtagtattcagccataaaaaagaatgatatcctgtcatttgcaagaacatggagggaactggagatcattatgataagtgaaataagccaggaacagaaagacaaacattgcacttgctcacttatttgtaggaactaaaaatcaaaacaactgaactcatgtggacagggagtagaaggatggttaccagaggctgggaagggtagtggggtttggctgaatggtgtgggagggagatggggatggttagtgggtacaaaataatagaaagaatgaataagacctactatttgatagcacaacagggtgacaatagtcaatagtaaattaattgtacatttaaaaatagctaaaagagtataattggattgtttgtaacacaaaagataaatgcttgagataatggatacctcatttactctgatgtgattattatacactgcatgcctgtatcaagatatcttttgcatcccataaatatatacacctacttaggatgtatgtgtagcaaacaacatagtatatatagggttcagtgctatccaaggtttcagacatccactgggaatcttgaaacacatcccccagtggataatggggactgctgtatgcaaaatatttttatgaagtagaattacaagacttggtgactgatcagataaagagtgcaaaggatatggaaaagccatgcatcatgtcttagtttggcatgtgcaactctctgggtgtttactctatttcttatcaatatagggactgctgaaggatgagttcagctttagacctgttaacctgaggtgcctgtaaaaaattcaactaaaagtggcaaggaggcagatggatctatgggtctggaattaggaagaggtttcacgggcagagattaaatttttaagtcaccagtaaaaatggtcattgaaaccaagggaatttgtgatgagtgtgatgagaaatgaatggggcctaagattgtgggactttaacaattaaaggtcaagtggaggaggagatccagcaaaagagagaaggattttctatagatgtaaaagaaaaatcaagagaatgtagtatcacagaaaccagtgaaagagagttttccacgattaggagtagttaagtatcccaaatggtactgtaagtcaagtagggtgaacattaaaaagtgtctgtcatatttagtaaaatggtgattactggtaacatagtgacagctgttttagcggagtgattgggggtagaagccagaatgaaataggttaacaagtgactggagtaaatatataaaggataaggggatcttgattttacattgtcagagaagagagttacaaatatgaaaaaggagaaaacaagaatgaaccctgtggtgttgaactggagttggaggtaataatggaaactcatggttttctctagatagatagatgatatataaatagataaaaaggtgaatattgatagaaattagtatgtatatatatatgtgtgtgtgtgtgtatatatatatataaatgtatgtgtatatttcctacctctgttcaccatgagggcctgggaatagcaataccccaatagcaatgaacacacctagtgccgagaacagaacttggcttctaaataccacgccgagaaaagaaattagcctccttagagaaatgcctgattccaggcacagggcagggaaagtgcaaggtgagactggaatatcctattaagacaaaaagtgctcagagaaagatgaggacatgtcaaaaacatgcaaagtccaccttgaagtggcagtcagtcactgtttacaaaacaatttgagcatcaaaataaacagaaatagcaagaaactataattcattgaataatatgaaaaatcctgagttatcacaggtatgaataaatgaattaataaattgaaagtttgatgagcaatacatagcttcaaagtacctcctcacaaaacacttcttaattacaagtgcatatgggatgagtacagtggagaagcctggaagataccatattaattaaatgatcaaagttaacattaccagtagtgggccaaataaataatgggtaccacctgataggatataatgcaaacacaacattaattctatgatattcttgccaaagatgtacaacccaaatctaagtatgaggaaacatcagaaaactcccaaattgaggggctttgtataaaataaccagtatgtaatctttaggagtatcagtcatgacagttaaggaaagattgagataatcttccaacctgaaggagactagagggcatgacaactaaaatgtagtgctttattctgaaccagttccttttgctataagggatgttgctgggatatgtgatgaaatatgaatagaatctaagcattagacattagtaatgtatgaatgtgaatttcctgttttctatagctgtattgtggttatgtagaataatgcctttaattttaggaaatacacaataaagaatttgggagaaaagggtccacaacttattcttgagtgtttcaggggaaaattatttgtactgtactttcacttttcagtaagcttgtgattgttaccaaataaaaagtaaagggtgaatggaaggtaagaaagtggagaagttgaagttgaaacattaaagaaggcaagagataattaactagctagaggagaacgtgggattcaaaaaggaatttctttttcaagtgggagagacaaaaccatgtttaaaagctcttgagaaggatctagtagaaactttggagtcaaacttacgtgtgagagaaagtgggagaaaagtgggatccagagcactggtgaagggactgacctttcacaggactcttcgaggactgtaatgggaggaagaaagagagcctgggtgcagatccaacctgatttcagacttgatggcaggaaattgagggagttctcatgtgatggttattttttctgtgcagcaggaggcaagggcatccattgagaatgaatgggcagaggagaagttagaagtttgagaagagaaattctgaaaaagtgtctgtggagaataacaaaatgaggtaacctgaggaatacagtaatatttccaggcacttttgacatcccaagtgaggttggtggctgaatttttattggtatcagtctacccaaaccgtatgatttttttccaatagggcttggctactgcttgtataggtaggggcaaggctgagagttgacataattcattgtttgaggcttttcaggaaggaccaatggggcaatggattttagagtatttgcaagagggattaaaatgatagaccatttgtattggaacttgggagaatacatttttctacattctttcttaaaggaagtcctacttatatagaacttctctaaccttttactgatggaaaaagcactgcaactataacttagtaaacttctgaagtgttagaaaaattcaaagttggatacttttcaagctgaaaatcttactcttcccaataaattacaataatgttcagtagtttgctcatttggcatcattaatcagaactttgaagtgcggtacataattttaggttgagaaggtcctatctgttcaggccatttaaaatgggttaattatatcgattctaaagtaaaaggacagctatcccatagtgcctgaaatccccaaaactaaagtattatctcatcataattcagatacctgtgtttctacgtgagctgcttaaatgttacccattttatttattggagttcagaagaagatttaactggaagtttctgctgtcaaaaaatgaagttcaaaaccactgatgggtctgttgaaaaaaacccttgaccaattttccaaaaatttcaattataatgcctgtattatcttcctcaccagagttttggaacaatgagctaatgaagctttgttaaaatatataataataagattattggtaagttgaagggagaaaaataagtctagaacttgaggcattgctcagagtaagcaagacttaggtagggtggctgttgggagtcttaggcagaatgaaggtgttatggtgcaagggtgagggacaaggacagaagagccacatagggaaacgcaggagcctaaggggagattataggccactgaagagaaactttgctattttcacggttttaatggtactggttcttgccttgggaatatctgagataaaatgatacaaccctttcccaggatgtggcaacctaaaagatgatgaagccagagaaagtgaaactgaagatgtcttaccaagtgtattgggttaaatggtacgtccttgtcataattcctaaatcctgtgcacgagaccttattttgaaaaagggtttttgcaaatgtaattaaattaagaatcttaagattagatcagcttggattaaccttgtgggcactaaatagaatgacaaatgtcttcataagagacagaaaaggaaaagggaagaggagaaggccatatgaagacagaggcagagactggagttatgtagtcacacactaaggaatgctgccagccacctgaagctggagaaggcagaaatgtttctccccagagtctccagagggagtgtggacctgctgacattttgattttagacttctagcctccagaactgagagagaataaatttcagttgcttaaagtcacctggtttggggtaatttgttatgatagctctaggaaactgatatactaagcatgtcatttaaacatatagcagttgcactgtagttatcaagacctcatgatgcaatttaaacatgcaggcctgttggcattaagcaataattacaatagtagcagccactgcaaacatttatcgggaattttagatactaagcactgtgctgaatgatgcaaatgaattattttcctgagtcctcagaacagctctatgttagaggtactgttattaacctcactctacacatgaggggactgaggcttaacactttgtctagggttttacaaccaccaggcagtagaacagggatttgaacccacacagcctgatgctggagcccacacttttaaccactacactaaactgctttcagaagttatttggatacaccacagtagttggtaataacttatgttctaaataagtctgattggctgaacaataaagatatttttgttttcaagttcaatctaaactcagacatttcattgctatacaatagacacaaatctgtatcacaaagaaacaaaagcttttcaagacatgtcctgttacttacttcaagtaactagagttgagtaaagcaaaaaatgataactttgatagtaccatacttaccctagccagaattaagtagggatgttgttttaataaaaatgttcattttactttttttatttaagctatttgccctatagtatatgcaaaggatactttaataaaatcattacaccttatgtagtagttgtttcttttgatcacaataacatgttcaccctttaatatgatcatattcttccttctttctcacatctttgtactaacttctgttgtcaatttattcagtctacataaaataatcggtataatagcaaaatgacatagtaatatggtgctatctcaaaattagtagttgctcctcaaaaataaaggcagtctgctctaccttgatgtttggattgctcagctgtcataggaaacccttctgcctagacagctccagtcccttggcattctttcttaatgatattttatttgagaagctaacaacgacataaaagagtaataatgtgtagtaggttcaatcccatattttttaatatctcactgtttgagacatcttaaaatgctggcttcctcaaacagaaccacattgttattttccaaaattctattccttcaagggatagagttctttacttttcttaaatgaaaatgcccagaaatgatcagtttgaagctgttggggcagaaactcatcttcaggtccaaaatcgttgatgtgtgagttagaattaatagacctaactgggagtcccagatctgctacttattagccatgtgaactgggatatgctcatagcatgtctaagatggcgtcttcatttgtaaaatgaggatgctatcatccatcctaacttacaggaatgttggaaatatagtgtaactatttgaaaaacactttgaaaactcaagcagtaaaccaaagtaatcctgatacatagaaatgcatgaactttcataatggacagagttggatttgaatcctagatccagtagctgtgtgggcttagaaaatactcttcccttgatttcctaacctgtcaaaggagatacttcttagaagcgttgtttaaatagacgacgtttatgaaagtagtacactgactggcatatattattttttttctctctcctctcccttacatgccctatttctgaagaacatctctagattcagagcaaatagaggattccatttaggatcaatggtaggtttcccttgcttgggactcttcaaaaaagccccaagaacagtgctgcaaggactactgtgaagtcaaagtgtcaggcttcaaattttcttagaaaaatcaatttgagccaaccaaaaatgaggctgcattttggaaaattggcctttaatatctagaaagttcaatactgctttcaccatactagatgggcttttctttcagtaaagaaaataaaaggagtgagttttactacttttgactaggtgactttatgtgtataagaacggtttcatccttttctaggtccaacagaaagtttcaccttaaaaatcacagataaaaccacttttttcttctttggtctattcctccaaataattccaggtgtgatctacaggaccttttgttgtatatggagtcaagggggcaagagaattgttggtgatcttcaggagcaaattccactttctaatctccagtatctttttccaatgttgaaagcacagctaccaaacattttcaaatacccttctggttttgctttgccatttttgttttcagtaatgtttgcttttctcagtgttgtctgtatattcagcctctgaggactaatgtcacttgtccagtaacctaacaatgatgttaaactcaatgttctcataatgagacattactcatccttgggatatttacagtaatacaatgcactggataatatggaatgtgatctactgttccactggaataccaatgttgcgcatcattaataaatgcacagtttctattatatgtgaggctttcaattagcatacatatttttgtcatcatatatcaaaccagctgacttcttctcatcttgttatttttgctgacttgaaaagctgaattcttattgtagcagtgtatattaaagtctgaactttgaaaaccactccaaatgattttcagtattgaaatggaaattcgattttttccaagctttctaaatgaagcaacatgatgtttttcttctttcaatcatttctatggtacctttgcaaaaagaccatatgctgttaacctaaacctggtgtatttagattacaatgcattttgcaaagtatggcccacagagtgcctgcttgggatccagttaaaaaatgcatattcttgggccccactgcagatctactgagtcaaaatgtgagggtgaggcctggaaatttttcttttaacaatattctaggtaatgtattctaaaattacaggatcactgatttggtgttgagagagttgacactcttccatttctcatttctttgcctctataagaacctttatcatcctcataatcttaatcctttctaagtaacatgctgtcccattgactatttaaagatacctaagtgttccatttaggacacaggactggaaataagaagattctagtcctcattttgccatttattttccatgtgacattggacaagacttaatatttctgagctttattttcaccaacagcaaaatggtgaaaagtaggaaagaagggagaggaaacaagatggttagatacattaatgtctaagattttgtctggatccaacattttataatttcatgaatgtttcagctgctagaaagagagtaggagagggaaaaagaggacagtaagataagctgcagaagtcactaggtttggaggaatggaatgagcatgggttctagaatcagacacattagggtttagaccatagctctgatatactaattatgtcatcttgagcaaattataccatgctttgagctttaatttctttgtttattaacatggggataacatatattctcacagagttcacgttatgattaaaagagatagtacactatgtacaatagtacccagcaacaggtgctcagtaagttaatggatatgatgaagaagagaaggaataagaggatgaggatgaggagaaggagggagaggcagaagagaaggaggacgaaaaggaggaagatgtggaggaggacaaggaggaggaggataagggaggaaacattaaggaatgagacaaaatggtgggcatttggtacctcagatttatttgaaaacaaatatctgttgggaatctatgatgagccaagtactattccaggcaatggctatacagtggtggtcaaaatagatattttctacttttgtggagcttattttctgatgtgtatgtgtatgtgtagggggtgatggtatggcagagaataataaatgaatatgggatattttcagtggtaataatggctctgaagaaaattaaagtagggtgagagggatgcagagtaatgaaaggtgggtagttgctattttatattgggtgatcagggaaagcctctctaataatttatcaattgaacaaagactcaaaggaagtgtgagaacttcacagctatttggagggaggcaggcagaaagaataccaagaagaaatgttctaaaacaggagcattatgagaatactgaagaaaaaaaaggaggccagaattctgcatatgtagctggagcagcatgaaagagaggaagaaaggttagtaggagatggtgtgagagaggtcacagaggtgggagaagcagattgggtagggccctgtagattatagtgaggaagtcacctttaactctgagtgaagtgggaagaccatggaagcttgtgagcagaggaatgacaggacctgatttacaaaggattactcttgttgttctgctgagaatagactctagggggaaaagatggaaacagggagaccaattaacaggctattgcaataatacaggtgagaggtgatggtggcctgggaccaggacaggagcagtgtagctggtgagaaatggtcagattctggatatatttgagaatggagccaattagatttgctgatggactagatgtagatatgcaagataatgatgatcccaaggttttgggtctgagtaactagaagaacaaagttgcatttagtgagatggggaagactaaaagagtggcaagtataaggaggataagttacatgtgtaaatcgattgctacagtaaggagtcagccgactaacatttagtgggcactcctgtgtgagaagcccaataacaggtgcgctgagattttattagtaaagtgctcttgttagtattataaggaaaccagagaacattgtctttagttttagtcgagtgcttgtaaaattattttgggaataagctgcagtcttcctaatgcgtgggaagtccacatcagagttaatatacatcagttttcagctttccaaagccatgttcattatctctgaacttcagctttagccaaatcaaataaaaactagtacaagttgaggggctgcaactttgctatttgcttactcagagtgatgccttaccatcgctccaataactgccttaattgttttctggaaataatgctaccccatctggtgggatgtttctgaagcattaagtgctccaaggaaaagagcttctttgctttacagtaagcgcgctgctgtcaggagcctcactggctgttttgtacttcagtttgtgctgcttcccaagagctgaatggaactctattttgtcatttaaatctaaagaaggcatttgcacactgatgatgttatctgaagttctaatttgtgcaaacattgatctgctttgagcagaagagaaatctccattcagacagcaagaactgagctcagattaatagtcaggggaaagaactgaagcaccaggaagagtaagctttttttttttttttcattttaggatgctttatcagattttctttccagatttatttctgctccaacaaagaatattctttttgagctaaatctaatttgtgtataaaaaatacacacccatattgatttcactctggtttaaaatggtatttttgcagcgcaaaaatctaatcaatacaatcttatgagttggactggtaatggtaaacatactaacagatatttcatttcatggggccaaagctctggaaattgataccactgaaaaggattactcattcaccattgggtataactttgtttacccaaccatgatataggtgtaaagcagaaatacaattatgctgtggccaacacacagggggtttttgaatagtagaacttgccttccccatttcccctaagggccatagatcgtacaagttggcagatcaaataaggatattgtgggaaatcgtttactataaatgaaaaaaagtttaatctgatagggtagaaaattagactgacatagtcgctgaagaaaaaaagtctcccaagccaagatcaactttttaaaaattcagcttttagaggagatggatttgtagatccttgaacccatgctgcttttttttttcctcacacatgtatctaaagcctttggttttgagcgagacatgctacgcctttggttttgagcaagacatgctacaagtgaaattgtaagacagtagttgccagggattcaaattgcagccaacaagccttttaacatgcttaatcaaaactgtagcaataccaaaggaactgtgtttcaccatttctagtgggcttaagtgtgaggaactgaaattaatcaaaagatataacctggacttacctctgcctcatgctcacataactcttggttgcccccactggagtaaaatgtagtgaaaacctacagtgcaggagcatacaaagggttgagactagaagaaataattcagctagagtacagaaaaaagcaccattgtccctaaatattatgaccctggaatataagattgatgcctaaagccaaggaggcatgaatctaaggaaaacagatggctattgctgttaatgtacagtcaccataggaggtggatactaaaaattcagatatagattttatgctggaatcagccaagggcagtctgggcaataacgataatgcctgtgagtaccatgttgtgatcgctgtgggtgaccagaagacaataattgatatttcctataatcaatttataagggggcctttctcacaatagctcatagtgctttctaattcactagcctaggttgacataggcacaaaatcactccattagacggagaggagataggtaactattttcattttgataattggaaaacagaggcccaggctaatttgtccaaaatcctatagcaatttggctgtatttctttgaaccccttcagaaagctgacaatatatcaactcaaaatattatcagattctgtttatagtgcaataataggaagtaattcttccatgcaatacgtatttatacagcttagacagtagatgttcagtctttacctttgaacatacgaagtcactaaaggaggaacataagttttaaatattcaaatttcactgcctttggaatctatttttcagtaaataagtgtcataatacagaaaagctatgaattctaccttagtcttctggtctttaacaagtttgcaaagtgtattgtcaactcaactctttgattacaataagtattgtacttcttcctactactaagcatgtgtaatcaaatatcaacaggaaatgttatttcttggtgggtccttattaaaatgaatcagtgagatttaggtataaacagtggcctgaataagggatgatacctccctccttcattcacacaagatcttttctgccagggaggtatttagatctttgtcctccccttcgtagaaactttgagggttatactggtttgtaaacatctatattgattatagtttctaaaatgatattataattaattattctttaatatctaataaatcactttatctcccaaacatgctaggaagcatgcgacttccttatttatgctttatagagtaggaaactgaggctcaaagaaatgagggatttgactaaagtcacgggttactcagtagcagtgctggaactagatctaggactcttgactcttagcttcagactctttccactacagcagtggcttgatgggacacttggactagtcagtataggttagattaggttgcagatgacccacctccccacaagataatagtgggtggaaacaacagatgcttatttttcattcatgctacatgtgcaatgcagttcagaaggtggtgctctgaacacaacttaggacactgtcatctcagcatgaagcttttagggccttccaaggcaggctaaaagaaaatggagatttgtgcaatggctcttaaaagcttccactcagaaatgctacacataccatctgctcacatttcataggccagagcaagtcacgtgatgatgcctaactgaaatggcactgtgccccaaaggataaaacaattgggatcttggtgaacactaatatgtctaccagaatactttccattcaaatgaagtcttaatcagaaccccactatataaaatagatataaagtagggagatccaaacctacttaacttactccttgtttctttggaagctcctaaggtacttttaaagaacatcaggattcagtgaacccaattcaaaatcagctgcctccaatatacaaagaaagccagcacaccaaataagtatctttatagtaaagataagaagaccaataatgtttttcaggatcatgagataaaatagaagctaaagtgggaacagatcacagaatgatccattctttatctcttgttctactcactagactttggttctcccactgtgatacagaaaatcttcaagaatattgtgacttttcatgtcacaatgtattaggtgcacataatgctacccataacgaatgctaagtctcaagtgcacagcatggttcagaaactaatttctaaaggaggcacacagttttagattcattttgaactccacagctgcctcttagtactaagcaacttgacttgcatgcaagagtaaatgttttaatataatatgcctgtacattttcagccttgctgaattttaaaatatgattttttcagaaaacaaaaattattttattggattgtggctggaaggaaaatgatccttttaaagatgaggaaggtaattcagtatcactagtttttacgaagaacattttcaatcaagacagaaaaataaaaatatatgtgtatttcagggatgcttgtttaggcatagaataaatatggttagaacaatgatttcaaggtgtgtgtgtctgtgtgtgtgtgtacatgcatacatatgtgtgtgtgctaggggacacatcaaaaccactggggtggcggggagcttttcaaactacacatactccactaccctcattctgataactcaccccaaactgagaatctgtactttaaaaagtcaccattactttttatgaaaggagtagcctgtcatagccctgaggtgagttgggtagaataaaaatgttgaaatctactaggttggaacagtgttctgtactataaacatctgtggcaacatttttttctaagaattaaacctagaattctccttccagcagtgtcacccatcccaaactatgttgataacaagcaagccatttttttacccaacaacaaattcccaaaagagaagagatttcttgtgctatgcgtttaaaatgacaacagatcacataactacacagaataaagatatttttgttccaggcctccacattgggtaggcagaggggagaggagaacctattaacctgaatgacctccttcttttccttgctttctccctccctcccttcctccttttctcccaactatctatctatctatatcatctatctatcattgatcatctatctatcattgatcatctatctatcatcatctaccaaagcacactcccacatcaatttcatgttcacatgtgaatgcaaagacttttcacatataagtatgctgctgatcatccagcagattagtgaatcaatttaccagtcctgcaatctattttcttcccagagctggaaagaaaataaaatccacattaattccatcctatggatggaacgttacctttcattgccttctacaatgtgtaaagttcagtgaaggccctacctcaaagtttcattttggtggtgagaggtactatttgaaataaggttgctatagaaagatgcttccttctgagatgatgaacaactgacatttgtatagaactttaccttttacaaagcattttctgattaattatcataatgtctcaagtcatgtacatcagcttaaacttcccctgttttccaggcctgaggcattatgaggaaaaaatagaaatgacccggataagaagtgaggttgtgaaaatccaggaaagggacaactgctgatcgcattgtgtttggttttaatgtatatgtaaaccaaaattattctgaatacaaaaaaaaaaggaagaacagaatggttcctcaagttctcttatatcagcaaactatttaaaaaatcatgtctttgaaaatttagatagaacccagggacaaaatgaagagacagtggcaaatgggagatccaactatcatatgggtcaggaggttataaagtatttcattcttcaaattattctggtgtcctctaaatatgtccacctcaccctttatttcatttctttcactgcttggtaatatctcatttgataatatcatgggaatcttttcctcaatgtttttttctacagctctaggtagttttgacttaagttaaagatactgaaaactgtaagagagtatattatttctgaccctagcgttgcccttaaatctgtcaactagggtctattttgacctattttaaatggcatcatctggtcttccttcagctaccctcctcttttggggtgaaaagtctactgggccaatggtataagcttatctggagtttgcactcctgatccccaataagactactccgtgggaagctgggtgcctagaatgccctgtctacatggccctaagcctactttcagggcctatggaggactctggcaagtttggactatgttgccgatatatgcgccccaaggcttgaaggatagctaaaggacaactgttttctgggggggttggggtggtggcgtggtatgtcaatagagtttggctggtatggctgagtccatgtatatgaagcctctcataatatggaacagagtcagggctgggaggagaaaggggttagaacataggcagaaggtctctatttgtatttttgctctatgttccacaaacgttaaggatggccctatctgtaccaattatatttgaaaagaatgcagctttacgtaaaattctctcctgatatccccctatatgaaatctcaaagtaatctagaaaattggtcatggtatagatcattgcacctaagaagttaatacatctacctcccaggaagctccatgctatgctcactggcttatgaaaacaatcttctattctcctatttctgggtcatgcatgtaaaataagactagactaaaatggggtggctgtccatgggatgggagataggaggagaggagccagggtttattcaagctagaagtggggttacccagacaacattttagaagtactgagtggtaacaggctgggcgtggtggctcacgcctgtaatcccagcaagttgggaggcctaggcgggcagatcacctgaggtcaggagttcgagatgagcctggtcaacatggtgaaaccctgtctctactaaaaatacaaaaattagctgggcgtggtggtgcatgtctgtagtcccagctactcgggaggctgaggcaggagaatcgcttcaacccaggaggtggagattgcagtgagcggagatcacgccaatgcactccaccctgggtgatagagcaagatctgtctcacacacacacaaaaaaagcagcattaagtggtaactagaaggcagagccaaggatagagaccaggaggaattgatcatgcttcaagagctaggaacatgcccaagatttagtatcaggccagtaactataaactacccaatattatgcctagaagccatcttctcaacagcattcttaattcctgtttttcccacaaatggaagaagacggcaaagtgttttgatgataacacaaagaatttacgcttactttttaaaaaaatatgtaaccttggatgtagaatgacaggcaaagtagctaagtaaatgttggttgaagtagcatttcatgtctacatcacaggtgttcctgtatgaaagtgtcttggcttcaaaccctgagttaaaagacttaaaattcaaacacatttattgacactcaagcatggtcccagtaattaaacagtctgtggagggcgaactgtactaccaattcaagaaacttagtatttactctgggtgcttcatgactggggaaatttgagcaaatcacttatcttctctgtgccttagtttcctgatctgtcaattgtgaacaatcatttcctcacaggttgttgtaccaaatataataacaattggcaaagagcattgaaaagtacaatgccatacaaaagtaaggttccgttatttttagatgaaacatcttacaaaaagtaacaatttatccaaaacatcttacaaaatctaacaatttctagagagtaacctggaaaaagaatgataatgcatgaattacctaagcttttgtcctttttcctctctttctgtcttggtttttagtagtgagatatatatatacttctatcacagctacttgatgacttttggatataggttaacttctatgaagtctcggtcacagagaaaatatttttattgagcatctactagagccctgtaataagtatttttacatgttatgtcatttcatcctcaatcaagttggtattattatgtttctttagggatgaggacataaacacttttttgcagtgataagctgtaaacactcagatctgaaccagccactggtggggtcacacacacacacaaaaactgtttcaatggaaattacttaaagtattctttaatccttgtcactatgataaggaaagaaattaaactgtctttggtgtgacttgccagactttggtcatgtctaaatgttgcctgcatggcgctaccagctcagttattatattggatatctgaatggataaattggccacatatctattctaattgataccacagcaactggctattaatatgaccaaaaagccccaaatcgaccacaaaatggtcattttcaggcgatgcctggacttcttatatgaagaagatgctgaacatctcttttctgcgttctgagaagactgaacaaaagttgatagcctcaaattaaactatataaaatactaattaactatcaggaagagtagagacagtgttctcaatgtgttgtccttgtaatacctgcattacaatcacctgggtagcttgttaaacatgctgctctctgatcctcattccagactccctgtattaggctttctgtggggagggtggtggcagaaatctgcatatgcaacaggcactcagttatgtctacgaatttaagaaacactgctgtagaatctgtcctcttacagagctttaagaaacacattcaacaagtgtatgtgtgcttgttctttgtagggttctatagtagaaatagaacacatggtctctacatactggaccctctagaacttgagttctgtgaagacaggaaatgggtttggagtttttcactattgtatgtgcagcatctaaacatagtgcctgtcacatagtattttgtaaatagctatagaatggatcagtggaagaccttacatagaaaattgacttcatgtgaatgtacagtagagaactacagcaattcaaagaagaaaaaaaatgaaggaaactacctgcccaagatgtgcctatctgaagaagggagactacaaacatatattaagagtcctctccccttttgcctcttggtgctaaggaaagaaaagcatctaacaagggtaagtgatctttagaaagatgaagaatccactgagattccccaggatatgaaattccactgttattaagatccttatagtcttaggctgtttttataattttaaaatttcttgttggcggtatcagttttgagtgctggtactactgatggtgttaattaagtttccttcttttaagtaaaacttaaggtgcttggtatcttgccatatgccctaaaaggcaatcctgaataggtatcactaaagaggaatgacaaagttggcttcagacaaaaggatcaaatggatttctaattgtccctccctaactttcatacctgactagactgaacagtgccaagtatgaggaaaatgatatatgtgtaataaaggtagactttccggagaaagtttatttttgaggtaactggagctgaagcagagggaaattgagaattgactagatataacacaaagaggaaagggggcagggaagaggtaatatttctgaccctcctgccagtaatatcaagcagcaaatgatcaagtaaaggttggcaggctagcctccgccttggaggttgccttgttgtaactctaatacctttgacatatcctgtctctcaaatcaatgaatgactgcattaggcccttctagttcagcttggactagttccagaaacctaggggtttccatcctgctgccctatgatttttactttaaattcctcggagacttgaattaagtttttcttcctgttatgataatgctgtttcttttttgtttttttcccagaaaggaaactagttcaccagttagtttttcccctgagttcttttagagtctataagaaatactgagattccgggacaaagagaccatctttaaaacttcaccagaagaggcaagaagctgtcagtgaaatgaaagagagggttaaatgaagggaaaagaatacccagactccattcatagccataataatccttaagaactttccttccttttcatgtcatcacagaaatgtaaaatctttaaataaaaatatagaccttaagaattatgaaatgtcagtatacttaagtcagtagcattcaaacttctttatcctgtggaattactcctagttgaaggaattctgtaatttttcccattccatccttcattttcccacttaatcagagagatatggttagacattcacgctgcttggactgggatgaagctttctggaatatattggattatccatcctatccttacagattatcatactccaaattattatgtatatgtacctgtgttgctttctagactttctacttttccatgatctgtttattgaggcatcaataccaacttgttgtatttacttaagctttataacacattgtgacacctggtagggcaagtcctcattcattagtcagtagagttttatatttttctgcacattttctgttatttaatgctaaaattattttacttggttttgtaagcatgattttttcctgttatattttctgtcccattattttttcccattatattttgtcattatattttcagcacattttttgtattatttaatgctaacttcttttttgtttgcttttgtaagcattattttttcccattacattttctgtctccctccataaccctgttgccatcattctttctagatctggccactctttttccttgtcaaaagccacaaacatctattttaaccagttgccttcatttccatattacacacctgtttcctaagttttactcatgtttgtttttaattacatgctattataagtaattaaaagtacattcaagactgggcacagtggctcatgcctgtaatcccagcacttagggaggctgaggcagaaggatcacttcagctcaggagtttgagaccagcctgggcaatatagcaagatcctgtctctacaaaaaattttaaaaagctagcagggtatggtggagcacacttgtagtcctagctactcaggaggctggggcaggatgttcacttgagcccaggagtatcatgttgtagtggactatgatctcatcactgaactctagtctgggtgacagagtgagaccctgtctctacaaaaataaataaaaaacaaaataataaagatttaatgcatattgaattgaattgaaaaatacaattcatattgtaaaactttctgctatgaataaaacaataatataccttgagctgccaattgtagttccttcgtgagacggtaacccctaatatctctttaataaatacttttctgtactttttaatacatttacattaataaatgcatgtagatacataactaatttgtgggtatattttaacctgaatggtataacattgtttatatttttctagaactgggaaatagctccaagacatattgttaagtccatataaaattaacttgttcttttagactgttatgtaacataccatcatagtctggatatgtcctatagtttagccctttacaaatggatatttagattgttcctaaaccttttttctattgtaaacaatgcctctttgtgcatatgtaccagcatttctctagaatacttcttagaaatggaatgactgagttgaggctatatgtattttaagttttgataggtactgataaaatattgtaccaatttatataaccacaatcagagtaagagtatacttgtttctagatacccttcactgatgtgtcaatatggaagagtgtaaaaaagtctcttttaaatttttatttccccgataactagtgaatcgagcatctttttcccttgctatttaaaaaactatcaatatgagtttgaacagatttcagaatggctcatagtaaaaggtataatattcagaggccagagttacaccatgtacttactctgtcggcatggaacaaatgatgcaatcaaaggacttgaactgacttcaagagtacaatcagccaacccttctgcaatcaggagactgcctggattgttcctaaatccttataggcagatgaaaaattgctgttcaaatcctctaaaaaggaaatggcatatatgccatcataagctattctaatttttgaattattctctctcccaaatgaaattctcccttctagccaaacttgatttctctgtatattacttacttcttttctattctttaaagaatgggagaagacctggtcaccataccctatcttaaagcttttcaagtacttgaagattattactaagtctcttctgaactctcttttctcggaatgaatgggggcctcaacctgtcctcaataatgtttttgaccatgattttaaattatgttgctttctacattccaaatcctctgagtccttaatacaaaaaaagagtaaagaaggaaaaaaaaatctcccaatttagcaaaaaacactcttgatattttggcatctttccgttaattctgtacactacgcaccttgtggagatattaaatacacattttagcatacttttagacttcctctgcctttaaaaactttctaatgtaaattaaaaattattcacaaatatttgtaatagttatataatattccaaatgcaccctaatttacctaaccattctgattctgttgcacacttaagatgtacctgactccttcctactttgaataattgctgtgaataaccaaattgccaaacttctatctagaaaaactagatggattactacagtattctgtttgtatatctcattcatgtaacgcataggattcagcacacagtaggggcttaatatattcttgttgtcttacatagagcctgagtcaagttttctccagagctgaaatgattcgtcttatcttatggaaataattattatacatgattaaggccacaaccaaacaatgtacaaaatatcaccactgtgtcactgaagaatacaggagttacttagaagaagggagtggattatatcttgtcattccatttaacaaggagttacttagcggcccaaagagataggaaaagaataaaacagaattataggcaccttcaccgtcagagactgggttcaatccatgtaatagagaaatctagacacaagttgagtatcccttattcgaaatgcttgagactagaagtgttttggattttgtacgttttcagattttgaaatatttgcataaacataatgagatatcttgaaaatgggacccaatgcagggtgcggtggctcatgcctgtaatccaagcacttgtgcaggaggcgggcggatcacatgaggtcaggagtttgagaccagcctggccaacatggtgaaaccctgtctctactaaaaatacaaaaaattagccgggcatggtggtgggcacctctagtcccagttactcgggaggccgaggcacaagaatcgcttgaacctaggaggcggaggttgcagtgagctgagatcacgccactgcattccagcctgggtgacacagcaagactctgtctcaaaatgaaaacaaaacaaaacaaaactgggacccaagtctaaatatgaaattcatttatgtttcatacacaccttatacacatagtctgaaagtacttttatataatattttaaataattttctgcatgaaacacagttttaactgcattttgactgtgacccatcacatgaagtcaggtgtggaatttttcacttatggtgttatgttagtgcgcaaaaagtttgagattttggagcagttctgatttcagattatggatgctcaacttgtaatgttgaaaaagatttcataaatcccctctcatgtagggaaagctggtggtgaatgtttttagcatttagcaaaaactggagatatttccaattttaaagtatttggccctgatactaaaaatggagaaatgctttgtgcaagctagcttacaactgagcatagtctgaataaacaaaagatccagacaggtgaggatgcgcttgagtttatttgtgttgtaatttggactacttaaaacatacctcttatttaattttgtcctactaagttttgggttatgtatggcagattggcactatttccattttttaaacaaataagttattatcaattaagtaactagctacatgtctcagaaattatttttaggttacttttcattacactgctagcatcagaacaagaaggccactttccagataattacaactccctttcctcccaaatccagttaaactagaaatattagattgaactttgtgaaaatatcacattcataggtcgaatatcagcaatttcatacagttcaatctaatattaggggtgggaaaagagggagagacgcatagcctgaccatttcctccagtctagtgtcaaccgccagcttcatttgcaaaacgctcacaaggtcaagtcttgacaagacatgcaagacttttgttgaatgatgctctcacaatgatgtgtctttcttttaagtgaaagaaatacccaagctagaaatcaaaacagagtagcaaactgtgtgcgcgattcagttttcaagaatattttaagttgcatatgttttcttttcattgacaatccttacccttgccatatcaggatgactgacactcttaatttgcaatttcctaaatttcaagagggttttttctttttgattgctatataatggtttacctaattatttttttttcaagttacagtttcggatgtttaatttcaaaatcaatttgagatgtcttgagctccattaatacactgtgatattgcttcactcattttctagcaaagcacttactttaaaaaatgcatcattctaatgattttaaattactctacagtgcacataccaatttacaactattacaaaattttacattttttcccaaagcacttcacatttaaagatgttctgtatttcaagacagaatgagagagagttaacttttaaagggcatgaacacaatttagggcctttaaaattttctgccctctctgatgtagaatgtaacctaagtaaataaaattttaagtgttcagtgtgcatataacatcagcttaggatgaggacattattataaaataattttctttttattcaaactaaggacaatattctttataaatggaaacaaacccattgtgtgtatgtgtgtaagagcaacaatctgttagtgtgtcaatttatgtgtaaatatgcatgggtgtatatgagtgggtaagcatgggcttgaatgtgtgcatgaacgtgcaacagtgtgtgtatatgtgtgattgtgtgagtgtgcatatatgtgtgagtgtgcaagagtctgagtatatgtgaatgtgagagtgtataagggttgtttgggtgcatgtacatgagtgtgtgcatgagtgtgtttgggtgtatgtgtgttcgtgtattcgcttgactttgtgatagtgtgtttgactgtatgaatatgcaagtgtgaatctttctgtttcaaatacatgcttggagatcaaatgttatttgtacttttatttaggcagtcattagagtgtgctctaagaattactttactaacctcagaataaaatgagggaaatgaagcacctcccaactgtatctataatacatctataagatatttgcattaaacacacacacacacaatttataccttgcttgaaatttgcagggaaaaaatagctatattcaaaatctgcatctggtaatatcagtttaatagatgtaaatcagctgccaaagttgggaaaccttccttcctcattgccctttaaaaacatttttgattactttattctctcagaattcttcattcacagtgacacatgccactgtcaaagcgattgaggatactttgggattaatatttaaaagactataattatcatctgttttcgccccagaccacccttgaagttgcagagagcactaggcacatttctggaatgagcctgatgctcattcattgatataacattttccttttgttggttaaaacatgctgctctagaaggtagaggcaaagccctgggggccaaagctaccatgtaataagtgccaggctcagggctagaatctttgcatacattatctcatttaatcttcactacaaccttgcaagatagtgttagtaccagttttcagaggaggtgctgtggctcagagaagttaaatgacttgcttaaggtcatgtagctaattaggagagaggctggtatcaattttgagtttgtctcactctaacactgtattctttgaattacgccatgctgaaaggtatgaccttcctagtatttatatcttccctcactgggaatggggtttctttgcctgcctgctactctctgcccctcaattgtcttctctaacaatccctaaaaacttggttgatgtcaagttcaaatctactttagaggcaatatatccaatttatgaatcatacttccgatgttaagattcactatgtacttattttagagtatactggcttggttaaaaactcactactgtctgtgtaatagacactatttgctcaataactattatgtgccagaggttttacacatattacacccattttacagatatggacaatgaagcttcaagaggttaggtaatttggttaatgatacagaagcagaaccaataaagtctacatccctgctgacagtcctgtataagcttctttggttagatctgggtaggtcaataaatctaatggagcctcagtttcttcatttataaaatggggataatggtactctcactgcaggagttataaggatgagaaaatatacataaaatgtctagaacatattagatagttaatacatgatagctattatctgagccattattgttaatgatgagtatgggttttagcattaaataaacttggcttcaaaagctttgcctcctactggctatttgattgaaatctgctgaatttctctaagttttcatttcctcatctacaaaatgaaggtagcattttacagcaccttttcctaaagtatactccaaagaacactgctatctgcacactatatttaaaaatgtgaggtgataactgggtttcctgatcaaagatccatgggaaactctggtaaacagatttccttatacagggctttttttagtatctctaatacgggaatgtgctttgtgaatttccaagtgggagctaacatatgcagtgtttttccctttcattatactataaaaatgcatttttatttttctataatatcttgcaataaaaggattatatagaagatactttggaaagactgatttgtcccaaagattaaatggataatatttgtaaagcacatatatagtaagagctcaataaatgcaacagtattattattataattaccataatcatcactataatcattaagaagggattagaaagaataagtttaagaggtctactatgcatcatggtgacgacacttaataacaatatattatataattgaaaattgctaagagtaaattttaagtgttcgcatgaaaaaacaaaataagtgtgtgattgtattagtccattctcacactgctatacttgagattgggtaattcataaacaaaagaggttgaattagctcacggttctgcaagctgtacaggaagaatagtggcttctgcttctggggaggcctcgggaaacttacaatcatggcagaaggcaaagggggaggaaggtgtctcacatggtggaagcaggagcaagagagagggaggggagaaaggctgcacacttttaaacaagcagatctcatgagaactcactatcacaagagcagcatcaaggggatcatgctaaaccattcatgagaaatccaaccccatgattagagaagctccatcaaccaggccccacttcaaacactggggactgcaattctacatgagatttggtggggacgcagatccaacccatatcagtgagggaatacctatgttcaacagcttgatttaaccattccacaatgtatatatatgtcaaaatatcatgttgtataccataaatatatacaattttttacttgtcaattaaaaaataaaatttaaaaagcctaccagagtgtcggtgatctgagtgagaaaaggcatgtctaatacacccctaggagtaggggtctacaaactctatagccagaggatttcctttgccagattagggcgagctactccaacggaggtagaagcttcagcagacaacctaccacataattccattgaatgtatgtatttattaaaatagaatttttagagccaccaaaaggttctttgataactaagattttttttgaaactcctcaggttggaattccacaggcaagcactcttattgtattgcactttctgattggttttaatgttctcatacgatcttgtttttagcacaggtatcttcccgtgtatgagttttgtctctttccctctccacttatctaagaaacaacagccaccataaaacttgacagatgtcaggtggactgctgctgaatgcctgactcatacaactggatgatcttccttttggtcctgattcagtttcccagcaatctagaaatgatttgcctttgttcttgtatatctcctgccaaggtgcacatagtttgcttagatatatggtccttttaaaatcatctttaaacttttatctattacctgctccttatggtagagttaatcattccttgggagctgaatttcagaatggtggtggatcctattgctttctaccagaagtcttaagggactgtgtgagttgctttcccatgaagcagtgttttagagggagatgcaataacccaaaaggaaaattcctcacacaaataaaaatgtatttatacaccaatcctgctgatactgaatagtaggatgtgggataaatctgtaagaaagtttgtctgtatctagcctggtggcaaacattatagattttacttgctgcataggactattgactaggattagattctcctctctaactacccatcgttaagatggatattctgaaaaaggtagacattaatcatttcttcactattttgatccttggtatagctgttccagagctatgtttgcatttacattttgatttactatgtaaggaggctgagaggtggtgatggattgagaggctttcacacactatgggcattccattgactcccaaggaccatttcaaccctgccctcatgtgccttaagtgaggggcagctcccattatggatgaattgctgctaattaaaatggatatatacactctgtcctactgtcatagtatgtggtttgataagaatgatgggcagagaaaaacaaacaaaaaaattctggccaagttaatgtggtgactagcaaaaataaatttagaaaaggccatttggattttatcagagtcaagtctatatatgaaaagcttattgctaagtaaaacctcagatttaatatgacctcgtgggaaaatgtgaatttggccgttgcatcccctaaaaaggccaggctccgtggcagttacacaaggtatggatttggagaatgaggtcatggcagctcagatgccaactgacagcttggtgatcccgagccacctctgtccatgtcccttatacagcacacatgattttttaaacacacaagctaaataaagcatcagaggaagacttcatggtgggagaactattcaaagactattctaaatgataaactctaatccttaccagtttgtttatagttattatctccataggtcttctggctggctggacccagagtgtgtctaactcattttatgacattaaaattctgctctctccaagttacaaacctattactttattagacattttatctaaagcatatgctggcttccttcttgagaaaccgaaagcctgagtttccccagcctatattctatataagaaacaggttatcgttaggtatttaattattccactgtcatttcatatttgtattctttatcatcttgtgtagagctctgagtattaacaacttgatgttcctcttgtcttaggaaatataaatatatttattcctttatatttcctggatacgattttattgtcataaactagaagtagatttaaaatggttacccttgctgtcttattattgccaaaaaggattgttagtcagttacattaagactcaaataatcatttttggtagaccttctccatctttaatccactttgtcaataatttcatactgcaagttaacttgtttagttaccttggcgttggaatagaatcagtttaatttggaatatatatgtagttacattttccaggctaaacttgatactgccatatgctaaagcactgctgcccaagagaaatataatgtgagccttaagtgcaagccacatatattatttaaagttttctagtagccacattaaaaagtaaaacaaaattatttagtaaaaattattaaaattaatttaaataatatattttatttagcccaatatatccaaaatatcatttcataatgtaatcaatataaaaattaataaggagatattttaattaatcttccatacaagtcttgaagaggagctaaaggagaagtgtctcattggtttcaatgaaaagaaaagttttattttaattgagctatgagtttgtctatcttgaggacactgtgaattacataattgatcatttttccctcttgtgttggctaagagggagttagaaagctacagtacaattagacattacttagctatgcacatgacttccttaaataaagattacatttctcacttcctttacagctaggtgttttcacatgactaagttatcgatcaataaaatgtaagtgaatgtttctggcagtagcttcagtgaggtcttcttaaaagaaagtagagaagtccctttgcctcgtcatttcttcatttcgcctatagtgaggatgtaatagctagagcactggctcccaccgtgtactataagggtaagggctccatcctagaaatagtacagtggtgagctggaagaagctttctttctgaagtcaccatacaagccctggactgcctgcctctagatttcttttgcctaaaataaaataatacttctatcttgtttatctctttttttccccttggggaggtacttccaatcactgaactataatcttagttgacacatcaggaatgtaaattttccttgaatgtgattttataataaacagcatggctcaaagtaaaggtagtgaagaggcagaatagctacttgttaactgactttccagtaaaacatatatctgtattctgcaaacacaggaaacaataccatttggatagtgacaaaagaacataaagactttggagtagaaagaattttcatacttcttcaaattaattcagctttacagtgtttaaagatgaatttccttgagatttatcatctactaatttatcttctacttacaaaagatttgtctttgaaatgtgtctttacattgagaattgacatacaatgccaacaatagctacaatctatcattataatttagtgcccactatgggaaaagcatcatgctatgtgttgcacatatgttatctcatttaacccctacaactatattacaaaatattaattatttccctattttacaggagaggctcagagaatccaagcaacttactcaaggtaatacaataacttggaaacaggcctgggatttgagttcatttctgtctgaatttttccatgctgaatctctgacaacttttataacattctgatagtcaagaaaaaggtcccaggatccttccccatatatgctcattgccaactttctagagattcagtggaactgttgacaatgggtagaatctgttaaatttatagaaggctctctgaatggtatattggataaaagatctaaaccagaaatcacagtacctgtttttcatactaactacgtgcctaatgagctatatgactgtccataagtcatttgacctttctggaactcagtttcctcatctataaaaggaaagggcagaactaggtggcatctaaaatctcatctattgtcaatattctatgattatgacaagtctgtcaaaaaaagaaatgaacaaaaagaagactgttggaaaagaaagtaggcaatcatatttagagtgccttaactttcattgcttgatatgcagaattcaatttaaaaaatgaatgaaccttcaatatctttcttggtaaaaaagaaaaaaactgaatgaacctagcagagaagtgtgggaagcttgttttgattgttgaaactacttattcttgactccactattaacctcactgactttaactgctatggttcctgaaatgtcttttgagcaatatttcttagaacattctttgctagcatggaataagctcttctagttttgtggaactggatctaatattgttacccataccttagtagactacattcttaattttactggaacttaagttgttttatccacttagaggaaaaatgctaatcactaaaaatgaattgaaatgtgaatttaggttacaaatagtttgcagatgtgtaaattgagacccatagtggttcacgtgcccaagattatatggaaagtcagagctgtgccaggacatgggtcatctgctgatttgagtgacccagagatttcatgagggtccagagtgagcaaaagtttttagctaccttgggcctgtgcaagattagggatatatattgggatatatatccaatctggaagaaaatgcgtgttgcagagacatagtagaagaaaatgatctgtcttagtcttgggtctatgaggatgttaaatatcaagcctcctctgagacctcatggccactagccaggtttcatgtgggtttagggttcgtatttgtactctttatttggcctaaagaattgcaacatgatattttaaagtttacgctgatttgtagcgtaggcaggtttctgacagaaacaaatgtaaatcctcaccagaagaatactttcttcatacaggacttagagagatttccaacctgtttgagctcacaatttaagaaagccaaaaacaagaatgcaattaatatccaagagttcaaagaagtaacaaaccatagacccacatccacaaagacttcatatgctgtatttatcagatactgtatataaaataaccatgtttcatgtaaccaaaaacacaattaagatgcaaaaaattacccaaaataatgaggcatattttttttaaaaaactaagtaaatattttagaaacaaaaagtaatcattgaaatgaaaaattaataaaagggttaaacattacaataagcatagctaaagagagatttagtgagctagaagataaatacggagaaattgcttataagataacaaagggaaacaaagatagtaagtaagaaaaaggagtaaaggacatggaggctagaatggaatggacagtctaagggaacttccaaaaggataccaaaagggggaaaatcaagattcaaagaaataaggactgaaatttttctataatttatgtgagacatgggttcttatattcaagaagctcagcaagtccgaagtaggataaaaataatgaatctggctggatgcagtggctcgtgcctgtaatcccagcactttgggaggctgaggcagccggatcacaaggtcaggagttcgagaccagtctggccaacatagtgaaaccccatctctactaaaaatacaaaaaaattagccaggtgtggtggcatgtgcctgtaatcccagctacttgggaggctgaggcaggagaatcacgggcgaaggttgcagtgagctgagatcaagccattgcactccagcctgggcgacagtatgagactctgtctcaaaaaaaaaaaaaaaaaaaaatccatacagttttttttttttttttgacagtcttgctctgtcacccaggctggagtacagtggcgcaatctcggctcactgcaacctctgcctcccgggttcaagcaattctcctgcctcagcttcccgagtagctgggattataggagcatgccgccacactcagctaatttttgtattttcagtagagacagggtttcaccatgttggtcaggctggtctcaaactcctgacctcatgatctgcccgccttggcctcccaaagtgctagggttacaggcatgagccaccacgcccggcccatactgatctttaagaaaggatattggggtgtgaattctaccagtggcctcaactctgaagcatacacaataaagtaacttgccctgcctctcaaagtaaaggagttcattcaactctaatatgaagaaactattacttaccctactcataccgtgtgggtgttatgagactaatagaaacatttttgctaggatactggaaatttggtagctggggtacaagtcaagttctttatagcagactcaactacccattcagagtctctatgagcctgaccttaacaagtttctaagtgaaaatttattgtcctcactctttactgaagaactaatttatgtccttcccatccctcttctccttctctctaatgattcagggaaatatatatgtaaatcaaatctctggaacagtcctgtaggtattttgtatcatcaaagctcaatatgcaatccaaactctaataatgaccctggatcatggccataatgatgaaataaaaaaaaacactggtatgtatttggagaaaaaaaataaaacaatcagataaatgcaggatatttttattacaggaatagtatcattcagcttatttggggtaagcatatggggtactcttctatatctccaatcacctgattttggaacacaggattgggataatttattctgatccttccccatggccactaatttttacacaattgaattatggcttccttcaacctctctcagccatctccaccacagagcctttctactttatcctcccctgtcagagaatttccatggcagcagggcaagctgtagtggtagacactttctccataggatctctcatatacagggacagacacaccttgtaaatacttccttttgggatctattgtcacttcatatagctaaaaatgaattgagaaaaatgacaaatagccagtgaatctagaattcagaataagagttgaaggaaggggaataatgaaacacaagatttacctgttttcttttgacatttccattggtctgtccaaatggattcttactgtactgtactttatgtaaataaacatgcactcaggtttacttacattttcttgcttcacaattgccatcttatttaaatatatgtctctggtttgaaaaatagttttaaagctttaatggtttggaacagttagtagagttagctcagacttatagagaggcagccgcaaacttaccttttacttcaaacttgtcaaattgtcaaaagtttcactatatattgcattgttgcctgctaataatggtataacgtgtggttttattgtctcagaacaaaaatgtaaaagatgtctttgaaaacatttgatatttgatgtgctttaaattgccttacaatcttaaattactatatatatatataattataaaatcttatggccattaaatgaacttttgtataaagataaagaatttttggatctgagactattttgtggttcaatttctactttcatttgggccaaaaaaggcctggggtgacaaatcatctctgagtcggatgtatggctatgataccactataatagtgtgattttttttccatttcatatctacctcccaaagatattcctgtagattcagtcttacacacttaatttgacttggaattgtcttaaggatgcttttgaattgtatttctagtgccaccaatgaatttcatttacttcaataatctagagttaatgttttaatctcactgtaatgttaatgaaatagctaccatgttttatgcagatgcttgttttatttaaccaatcaaatcagagtcaccttaatgtttatcttttatttttttactgagtagaaaaagaattatttaaaaataaatgtgagcacaggttgtcatactttgaatatcaagatgaaaataatgaagcctgcatatgaattaggcataagctttttgtcttttatccactaaaaagcactataaatcctcctatcatatttctgtgactacctatatttcaacttttttattgccccatatgatctgcagaaatgaactttaagtccagggaatttgtagcattatgataatattaacattattgctaactaatagaaactttttttttctgagaactcagttactatttctaagaaacccaggtgtgtgtccaaagctgcagagaagaatgtacctgcaatcgtaggttcctaatatggtgacattaactgtctctttgtctactgaagatgctaaattctaaatatcttatatgtgagtgggcttttcccttcagtggcatgatgaatagctgcgtagttatcctcatggtgtttgcattacattttgaacaaagattctttaacagatggcatgtatgagcctgctgtaactgttatgtgtaaaggaaaaaaaaacactgtgtacacatgaatcatttcataagacctaataaattcctagaaattgcagtaaagtgatgcattacatgtgctagacacgcagagtcatgtgaaaaatcttttgattactggcactttcaataaacgggagaactaataatgtttttaaagcatatggtacttgtataatcaaggaaagtttcctcagcaacaacaattatataaacctcttacaacctcctcctctaattatctgttttattagtagatgcatatcgtcatccattagggaacacttcaaaacgtaatgagacattgttataatgaagatatacacacatacacatgtttatgtgtgtatgtatgtgtatctccatacataaagggaaatcatcaaataacatagtctatatatcaaaatgtggatgtccttataatgaaaacaaagctatttacaattaataaactcaagagagtttatgaactaaatctatggaccattcataatcagtgtcaatagttcaatatacagtattaagaatcatagatctcagtgttggaaaagacctcatgggccattttgctaatcttccactatttcacaaatgaggtggctaagactaaaagaaattaagttattcatggtcactgtgtgtgaatacatgcacacccacacatatactgatatctttctgatggacaaggtggacacatgtcataggatagtgtaaaaagaaatatccttataacaaagccttctgacatgttaaggaactaacgttccttagaaggggcacatcatgataataccttatatgatttctgctgaatagcaaatagtatgttgaaaagaacctccaggcctaatgcttcacatctctccagctgattaacccacttctaagatacagcataatcagagaggattgtagcagagaaaggacaagagttggcctctctattaaatgcctaccacttataaattttgctgtcagttatttgcaagtaatgatagagggagtggttcaaaggaggtttcatcaagaagagagtagtacaaagttctaaactgcttttatgctctctttcaaagactatgtgaccaggacaagtcagattttacaaaaggaatatagcagatacattgtgcaatgctgatctcagaggctagggccaatacccttagaataggctaaatgtattactgagatttcatgataaggagttatgttttaagggagcatgatttgacctgtagtatatccaaatctaaagtatattataacaagctgctattgtattcctcttcaggtatttttaaagaatgagttaacctttgtgaagtgtcgtgaggccatcaggttaaagaagcctatatcaaatatcattttagagctgttaacaatactcaatgtacctagaaatacagactgaaaataatcagtaaaccattcactatagtccccctggtatcagagcagcacagttaacatgctaacagctaagcttcatgtgcttagtggaagaaaatgatcaatggcaaagagcatatccaccttggaaatgacatgatccattataagaatcagatgttaaattgcttcctgtactgagcacactcaattaaaagtctgcacagtgagatcatctcgatggttaaatatgctctgtgggaacaacctttatggagcttaaaaatcacagaaggactattcctaccatgacactggagatttggaaggcatttccttcccttatttttcaatctgctagttttattaggaagccttttgcctgagaggctgctgagttttgggtcatacctatccacccttttgcttctgtgaacaagagatgattctagtgatcttttttctttgtgatccagaatggatgaatgtggctttggtccagacctctgtacaaaaatgtgtcatttatgtacttggtatttgatgtcctttatctccttttcagcaaactaatctattcacctgagttctgtctccttgtctaacttttccttcttcctttggcaggagtagggcctgagggctgaaaagaatgctagacattacataaaatcagcagacctggtttcttctggcaggtttgcaattagccgggtctatgaccttggaccaattatttaacctttctggttctcagtttcttcatgtttcaaaaactcatatatttcttgttcattttttaccatctgtctctccctgacagactgcaagctccattagtgcaggaatctttgttttcttcactgatatatcccaaaagtgtagcagatggcacaaagaagatattcaatgaaaatttgtttaatagatgaatatttcacatctccgttagtagtgttaccattcatatagtctcccaatatagaaatcatggagtcagtgaaattcctgtctccccttatacccacatagtcaccaagtgctattttcttttttcttttcttttctttctttctttttttttttttgtgacggagtttcgctcttgttgcccaggctggagcgcagtggcacgatctcagctcactgcaacctccgcctcccgggttcaagtgattctcctgcttcagcctcccgagtagatgggactatgggcgcacgccaccatgcctggctaatttttgtatttttagtagagatggggtttcaccatgttggccaggctggtctcgatttcttgacctcgtgatgcacctgccttggcctctcaaagtgctgggattacaggtgtgagccaccgcgcctggccccaagtgctattttctaacccctctcatgtctgtcctttcctttccatctacacttaaattcccttatatcaagtttgcgtcatttttttgactatattctacaaaccatttaccgaatggtaatggtaatggtaatctccaagtcatttaccgaacgactttgctaaaatgcaagcatggtcatgacactaccctctttaaacaccttaaatggctttcctattgtcctcagggtcaagtccaagctcctaggcatggcatacagagaccttcatgatctgtggtcttttgtgatcacttcctcaaccatcagtaaatattaaagactctttgcacattgtatctctctctctatcttttagcatttagtgcaaggtattttcacctttattcacatttgcctccccaactatagatgtttcatccttctttgtatactattgcctcacatgctgtcggagacataataggggctcaggctcaagaaatgttaggcaaataaacaagtaaatgaggaggttttgactagtgcagtagttctcacactgtgaggcaaactgcttaacttctctgtgcctcagtgcattaaaatccatagggatgctgagatggatggaagaggaacatttaatgaatattgaatcagatacctacacttttttccagatctaatattctatagggctatcatttttttccctcatcatttcatttgttttggtgggtaagggttgtttggggtgagaaaggagtggggtagggtttagggtacttcatctggaagagagagaaggagggggcaacatacaggcatgttcataattacccttttcctcccattctgtgattttcttcttggccaacaggactagtgcatgtctttgtgtgttagggagtaggaatgggcagggaaagagaaactctcagtacattgaatttaatgttaactcaatggaaatacaaatatttgaatttatgcaactggagagtagtacattaccaggaattttatctaattctgaggcatcaggaagggcacataaaggatgtgagtgatctgagggagcaattatatgattcagaatcactgtttgatcaatatgtatttattaaatcatatataaagaggcaagcttttgactcactgtaaagcaccctaccatagtaaagacattaatgttggtgttctctagggttctgattttcttcattctcattttccacactctccctggacagtagcttgcattcctgtggtcccaaactatgttccaaatatttgtctgtagctcaggattcttctctaatttcattattgactatcaacccctcgctggccatatgcaagcgggatcttctgcagatgcctacaacacagcatgtccacaactgagctcaccatagctggcccctctgccccaaacctacttttcggcctatgtcttttctctctcagttggcggcacttacttttgcctagtcatccaaagcagttaccctgtctcttttctctacatctaccgtggtcattcctctctagtctgtttccacctcaccattctcacaactacagcttcaattcaggcccttctcaccatcatgctccttgactactccaataatcacattgcacatgtctcttagttccttatatcattcagctacaattggtcttctcaatagtctatctcaaaggtggtttgttttaaatcactcaatgctttcctattgcaacaagaagaaatgcaaattcctcagcatagtgtgtaaataaaactccctattttctggcccctgctcatctcaccagttttatctccttctgcactcctaggctatagctatacccaatggcttgcaagtccccaaatgtgtcatttagattcatagctctatttctttgtttaaactgctccttctgcctgaaatgttcgttcctctcttgtccatgtgataaacatgcaatcatcattctggtgttaattcaaatgttaagacttctacaaaaccttacctgactgtaaggcttcttctcacaaaaatagtctactgctccctcctttgtgctctgtgacacagggccctggacatggtccaacaatgatacatttttatatgtggtgagttagataataaattttagaggacagtgcagtatagtggtgaaatgtatgaactgtgaagccagaagctatatgattatatgattgtctctgggcaagttatttcacctctcagtgccttggtttcctcatctgtaaagtaagcatgattatcatacttacagagttgttatcagtgagttaatatatgtacaatgcttacaatagtgactaatacataataattattatgtgtttgctacaataataataacattaatattatcatttttaacttaaagctctaagccatgatagtgtatctgaaacatggaaggatggaaagtattcagtaacatttagtaagtaaattaataatcaagttaggtccctattgtacagtctcataatacccagaaactttccctttgtaacctttttctaacttgttcaatgtctctctgactaaactgtaggatccatttgtgcaaggaccacatccaccgtgttcactactataaccctagcatcaagtaccatgccaagcacttagcaggcacatgtatatttgttagacataaaggttatagaggttatatatacatataacctctatatgtatatagagatatacatatctatatcctatacctaaggatatagatatatatggtttttaagattttcattttcgttattattagattacctttagcattttgatcattttctgaaattgtaaaatgtattcctctttcctgtattacgtctatgtgaggcaacaaaatttcagtgaagtattgttagaattgcagtgaattattacgctaaaattaagccttttaacagagaaattctcctctttccttacggtgtaggatcacagacttttcagctcatgagctaatccagtggtacaaaaagtcccacagtgcttcaatctttcctgcttaccacgtcattttacatctttaacaaaattcataggcagaggctttctaagagttaccacttattaattatacttatttaatgagtacatggtttgaagaaaaatggtataaagaatgacttgttatttttagaacttataattcaggcaaaaagacaagccatgtgcacacatatctacatcacaatgttttctgtgctctttagcaatgtgcatggtaagatttcaggggatcctggccggtgcagtggctcatgcctttaatcctgccactttgggaggccaaggcaggcggatcacgaggtcaggagatcgagaccatcctggctaacacggtgaaaccccatctctactaaaaatacaaaaaaattagccggtcgtggtgtcacgcgcctgtagtcccagctactcgggaggctgaggcaggagaatcacttgaacctgggaggcggaggttgcagtgagccgagattgcgccactgcactccagcctgggcgacagagcgagaatccatctccaaaaaaaaaaaaaaaaaatcaggggatccctgttgatgtgatcaggaaacattttatggaatggctaaaattatagttagtcttgatggacgggttggatttcactaggtggaagtacaatagcatctcatgaagaggaaaaggcatggagaaaagcataaaaatatggttcattaagggtaaggagagcacatagattactttggcaaaggaacgatttatgcaggaagcaaaaatagaagataggctggagaaagatttttggaatagtttgtggtaggcttttgatcatagactaggacacttgaagtttatctacagataatgggaaactatagaagatgctagagtagggaatgaaaaaaggaaagcaatgttgtaggaatagcaattgagtggcaatatagcaatatgtaaaatgggatagagttcctgggctaagttgtgcttttaagtgatgggacacccagtagaaatatttcgcagatggttggaaatgccagattatttgagtttgggagagatataatttgaaatcatctgcatagaactgacagtaggagacttgggaatgtattaaataactgtaggagaatacaaaatgaagacagaaattcaagcacagacctacaaggaaaaacaagatgaaaaaaataggtaacagcgtattataaataaaaatgcagtaaaatactaacctaggacatacctggaaacctcttaggactcacaaaggtgtacagatcatattttaagaaacactgccttaaggaaggaacagttagaatttaagagtagaggaaggagaaggaaattaactccactacacctgttgagcagtcagatcctgtccacttgggatcacagctgcatactccagcgtccagaagaaaagttccgtgtcctgagcactgctcttgacatacaggaagtggtgtttcacagttaactcctccccagccagtagaacagtgacattctccttttacacagatgccatggttggaacacattgggtctaggcagtcctctgaaggcacaaaaaagtgggggggaggggtgattaatagtgaacaggtatggccaacataccttagtatgatgaaacggagattacattgatttcctagtttatatcatcaatgctgctttaattaggcaataaaatgactcatgcaaacactctgtccaaaccatattattaacacttcaaaacatggtggggtatcacaatggttgcaatctcaattgagaaggaaaaggaaaccacacatgtgctgtgtgaaactgtgaacagtgtgcagtacccccacacaaataagtgggtggagtactgtgggccttcaacaggaattgctcagcttcgcaaaaaagcccaagagtttttgctaagtcattccttatcctttctgaaaatggaagcgatagctcccagagaagacttttacttgatatgtctagaggagtttatataaatttttgaaatttggattattcaaggtattgggtgaggtgaatgctgttgcatgaaataataaaatttacatcaatttattataatctctcatttattccttaaaagtactgaaaatgtaatattttaaacttaatttaaaaattcacttcttcatggcttctccttctatgagaacacggtgacatagttttcagtgtcttagaatatcacagatccaattccatttgtctctgattctgtgagtctggaaatttttgtatacattctaacaaatgtgtatactgttttagaggtaggttcttgtgcttgcctgggggaaaaattgttttgtgattttaactagtaaccattccatgggaaatagaaaggttgatttccaaatttctagtctttctatacaaataaaatgagactaaaataactaatcgtaatgaggacgtatgatttgaattacttctccagcaatgcaaatagactgtgacaacccgcctgcatttccaagactgcctagttttagggtgtggcttgggtctgtggaacagagtaagtctaactaagcactattataattggtgttattgccactataattagcccaagagcttggagtcattagcacaataatttattatctgagctaataagcaaataaataccagaaggtacatctaatttgattcatgatttgaagagagagggaaagtccaaagtatagaatctgttttcagaagaaggccattttgttatattaaagaataataattttaataaagtagtatttaacttaatacagcctattttattaagaagcctgcttcaatgtattcatggaagtcatatttaaatcattcatgtcatatttaatttagaagcacaaaatcatatggctaaaggggccaggcaggtggcatacaggaaggaaatgggccatatggaagaaaaaaagggtgtgttgggagcaaactgaaagcaagcgcccttttaaaaagaactgctgctacttggctccagttgattgccaccacgtagcaatgtgggcccagggtcaccagattttctagtgtttagagaagccagaaataggaattctcatgtggcagttccctatttttaaattttggcaaataagtcacattaaacaacagcaacagcagcaacacagtgtgagccaaacaaaacccattcagaggcctggttcagcctgtgggctcctgctgcaaagtttgacttaaaacatctttttttctattgcattggaaaaatttataccattaaatgtactgagcattattccttaatatcttggttattctacagatattcttagtgaccccggagaagacaaatttaagtgaactcttttctaaactgcttacaaaatttaaattagaggggtctaaattaattagattacatgtttttcatggcaatttgtagatgtgatagtatttttttactaacactgtgtgggtctatatagcatatgaatttgcaacttaaatataattatttcagctggatcaccataaaaacactttctgaaagtaactcagaaactccagtgccttgtctaggccaaatgccatttatatataatataaatggcatatatatatatatatatatatatgtgtatatataatataaatggcatatatatatgtatatggcagatatatacatatatatgccatatatatatataaatttatatatatatggcatatatggcatatatatatatagacatatatatataaatttacatatacatatatatatatatatggcagatataatcatcacaccaaaattctactatcgctaatgggaggtgaaaagctaaagtcttgcttgttcatggagtggaatgagattaaacccgttagaatgctgtgtaatagtcttaatgagccatctttaaaaagcaattattgtgcatttccagcagcctctttcccgaacaacagttatgatgagaccatctcccatggtaatggtttaatattatttctgaaatcagtcttgtttgaggaatgtagcatgaaaaacgtctgattactagtaaacttattttccagtgcgtctctttaaatgataaaacttgccatttcaaaattttggggggataaagactcctttggggtgaatttaatataaaggcatggctttgaaactcattagtagtaagcctgcttccttaggcatggaggtcaagtttcagcatgaggtatgtaaaaataaataatataaagcaataatagtaatggtaattacaaaacactcccaaagaaaacatttgcaaaatggctgcaaacgtgcatatattattatttttattatgtgctttaaagtgagatgtagcataatgcattctgtaataatgaaatcatatgagttaacacctaaaatcatcaatatggacattctcaacctagaaaatagtgagagaaattagggatgtacaatactatttttcattattgctctgaaagtgtcacagatacagcctcatgtataacattagaatctgtcagaagagacaagagctccgctgacccaaaccctctgctgcatgtactaagacgctgagcatttattgtttgcaaaggccacttgcatctctactaggagaacagaatgacaccttggacaactgagtgagagaaaagcctgaagcaatagattaaaatgggattctgaccttcctcgcatatttctcctttgtatcctggcacacagatgcagactcccatgatgcaggtgccgtggccaaagcatgttggatcaatgcattgttcttccggaacgtcacactctggccccttccagccatgccggcagacacagtgtcctttctcgtattctccattcccaccacacagcacagggcaggaatctgaaggttggcaaatgaacttgtaatgttctcataatgctttcaaagtctccaaagagcaattctctattgattttcgtatttcaggcaaaaaattgtactatttctgtcttaccctttattaaataggcacatgttcatgattacaaacagaattttcctcttatgggagtgaaataaaggtaaattaaaaatatcctgagtggagaaattatttcaagtacttgcatttgatctcaccctactcttaaactgttattgttattattttaagctaggatttttctttcttatatttttcttcctcagggagatatgtgtttacttttaggaagcaaaatctgaaaatttaaaaagcaataaatgaagttattaatgttataaaatattatctttaaaaagttgtgtaattaaatagatttctattggacagatgtctgttcctataacacattgtgcagacctttattagaatgctaattctgctttgtcattgttagtctccttattaaaactatgcactttttgaggacaaggcctgtattttttgtcttattgattttttaataccaaccatcacctccacactcaacccccacctcctcaagatctatcatggtgctgggaacctagcaagtgttttagaattcgctactgaatggaatttaatagaaagaaaccaagtgtctgagaaacctgatattaaaatattagcagactgggaactttaagaatacagtgaaaatgagcagaaaacatctctgaaataataactgtaagtctacgggaaaacatgatgtgatttacctaaagcttttcaaaaattaaactatgggcaagtccaggaagagtgaagtttgctaagtttgacttctgactttccagtcgttactttgtaggctccttactcatttggtgataacccaccccttccacatacattggtgtgtacaagcagttatcaacttagttcacttttaaagtcagctcattatgaattagtttctgaaggaaatacaagcatcacatagtgactggtcagacaacctatctacaaatcccagctgttaggtaaccctggttaagtcacttaaactctctggcattgtttctttgcccataaaaattggataatagcagacctatctcatagggctattgtaggaagttggaattaaaagacggaacacaaagtgtttagaacagtgcctggcatagtaagtgctcagcttttggcagcagccatagggaacactgctgctgttgctgtcaccactactaatgttacttactatgactattactactaattctgggttatgaaatcacatctattttcctaaaccaatcagaataacagagcaacattacctctagcacagtcaggtccaaggaatcctgggaaacaatgacaatggccagagatacactctccatttccattgcaattggttgaacagtcatccattatttctagtaatacagagaaaaagataaaaaaaatgaacgcatctccaggctgtagagtctttatttttttttaagttgcaggaactctggacctatgacaattttgccctttgctgtttgtggagcacttactgctcaaaatcacatacaaagacatctgtaagatgtcacatgcagtacaaaattataaaaagggccctgggtttgctgacttggccaatcaagagtggaaccaaaaaacatcattatctctaaagcacataaatgttctagttcaactgtattcttaagagacattcatgataaagctaaaaaatgtaccaggattacagggcatttctcaaaagcaaaacaggctttaaaatgtaacacagatgactaagtctactgtttatttttcaaatttaggttttagcaaataaagtttcttctctagcaacttatttaatctactatcttgacagcttaaatatgatattcagtatttcattttcattaataagtgacaatggaaggcttttaaagtaagtgttcatattaaattcaccaccactaaaagcattagaacctaagtattttgttgagaaatgctttctgaactgtaaatgcttatccgttttctgccactaatttcctttcaatccattcttagagaagaatggatttcagatgaattgagatggctttgaaggtaccgataggtagttctggtgacataaatatgtaccgtgcaacagaacttttataagacttacagtaacttctctgaaaatctataatattatacaaatgtcagtctctctgacaatgaggtgaaaaaatgtttgtattttaaaattgtgtttgagcacaataatgatcaaattctaagtctgaactattatggtacctatgctttattctcgcagggatttttttttgtggtgtgtgtgtgtgtgtgtgtgtgtttgtgtgtgtgtgtgttatcgtctcctcattacacctttctataaatttctcatactcagcattcttggactctgagtttagtgttctggcctattaaactcacacttttcttgtgtaccattttttcccttttcaatctaaattacctgcttcaccaagtttcacttggataagctatttctgattagaaggagagattctaggaggtggtcctgatatcttccactgaacaataagagtgagaatttataatgagggtcgagaaatagcatttctacaattgtggcctgtggattacttgtatcagtagatcacctggggcacttaaaatggagatgcctgtgtttcagctctagatctaccaaacctgcttcagaggaatgcagcccagtcatctacattctgacaatcaccacatgagaacattgagaaccaatgctttaaatagtaaccttccatagttagagaactttgttctaaatgttgcatttttgccttgagaagaataaaaacaagaaaaagaaagaggtatctagtccatttgggggattcttaaaagctgagaatgaatccagtggctggatagccaccctattatcaattgaagatattatttgtctaaccactatgtgaacacatgccttttgcgggtttatgccagtctggtccctcatcacagtgttagaaaactcaaatggataagcaaataacacctgacattcacttaaccacacctgggctgactgaaatgtagcattcagcaaagagccaactatttttaactcattaaaacactagttatcatcagaaaatcactaatttacttgacaagtagttatgaaaaggcataaagagactttttatcattcagagatggaacaattatttatctgttttctacttatctagcttccttgtaccaagcagtagtgccacttcttaagtctacatttgaatttcccccatgctggatggttagtagaaggccatagaggaagctttcaaaaataagtatagttgaatttaatttcataccagatcctattggaaactttatggaagcagccttgtgggaatgtagctcttctggaaaaaatgtttaataaagcttgctatcaaaataaataaaaatccgtacatcttattgacttatttaagaactgtccctgagctcaaagggctttacaaagcttaaccccagcaatgcaaatgagaagagaaggcaatataggctttgaagctgccacttccactgggtatcaaagagacattggaacagccgagggactccaggaggaagatggctgcagcaggaacacataaacaactagccatgaaaaaaaaatgtgtttttctatttatgttggcctccagtaatctttgacttctatcttttaaatcttacttcagaattacttcctagagtccagtttcttagaggtgagaataattttgaagttctatgtttaaaccctgttcttatgctacagtcaaaagccccttgatatttgcatcttcgctgatgataggttttgtttctggtagttattctcatgggagaaactaaatgtaatgaatactcttatagaatgagtatagtctaaagggtatggaatttggaatcagacatactggttctcaaatttcaattttgccacttgctgtctgtgagaccttgccaaattatttaatcttttcaagcctccattcagttatttgtaatatatgtatcactattcctgagctatctgggttgtgatgagaatcaaacaagataactgagtgtaaagcatctagtacagtgcttggagcagagtggcattccataaatgctatctattatcctgctacagagcaagttgcctgagattaagggatactgacaatgctgcctatactactggaaaataatatataataacttaggccagtgtttgacctatattagtcatttagtaaatgttagttattaattgtcttcatccttgttagtagcagaccaaatatagttgagatcaatcaactgattctaacattatcatgaaatagataaatgagcagcgtttagagcaaattcatacaaatctgactttgtttaatcaagtatattggcttctttttactctgattaagataaagttcaaaaacaaaaataaaatgaggaggtcaggcatggtggctcatgcctgtaatcccagcaatttgggaggctgaggcgggtggatcatctgaggtcaggagtttgagagcagcctggccaacatggtgaaaccccgtctctactaaaaatacaaaaattagctgggagtggtggcaggtgcctgtaatcccagctactctgaaggctgaggcaggaaaatcacttgaacccaggaggcgaaggttgcagtgagccgagatcgtgccattgcactccagcctgggcgatggagagaaactgtctccaaaaaaaaaaaaaaaaaaaaaaaaaaaagaaagaggagaatttagggtgaatgacttacaagccttttgattttgggaaaatttacttgagttttctttaagtggaatggtagcagaaacgtttctgttgcttctaattttaaaaagacaagagaaaagtaaagagactgacttgcattaagcaaagagcaaatatgttgttgtatatgaaactgacagcttgatatgtggatgatatgaattgtatctcaaagtttaggttctttgggggaggaagtaagggacaggaaaaaacctctaagcatgtttctgggtctattgatttttggaaggttaatagatcggttagtgttttaacttgagctgaaagagtaagaataataggaagacagaaagtcttcacaaatattttatttcttctaatttatctaatttttaggagaaactcaaccttttataactcctcgacatgcacataattaatattaagcctccatagaaaaatgccatgaaatattcatccattgaacctgccccactgagcctgtcaatagcaaaacagtgacatgacttaaaaatttattttctattttaacaaacaaatattttgtcttttgaagatataagatcagtggagtttttctctaggggaaacatcatcatttccattgtattgactttctgattactttagaagaaagttttgataatcttacggctgaaataccattttctattgactcaaggtcttcagcatcaagtaaaaatagaacataattgttaaaaagagcagatggtatatctattaaagtcaacacatcttcctaaacatatggctgaacaggttaactaaaggataaagtggtgaggattgtattgaaaattgacagctgtaaaatattttcttgtcttttaaaagacatgtgttttaggaaaattcacacaatacgatactgtgtctatgagttgtttattttcaggactctaaaattgctaaggagctcagctttattcacacaaagggtcacgaggactatttatcctaaaatgacaaaagagtgagacgtctgaaactaattagggtgaaagtgaatgagtataggcaggcatcgcattaaaaagaacatgttttaaaaggccctgagcacactgaaagagacattgtgatgaatttcaaactaaaatattctataagaaagggctttgaatgtctcaagttattatccttaatattcttctgtaaataatcttatgttgtattttaaagccctaatgcttctagaaccagttgttctaaagaagaactgtactgatactagttttttctatttgaaaaaggtattcattgctttttaaaaataacagaacttaaattaacttgcttattccctttttcactgaaattgttcatctatgtagccttggtaataatattactaaggtaattatttctgttgagagcacataaaaagatgtatggcaagtgtcctagaagagcaacaaataaagtagcattaaaaaaaatcttaatcagcatttaaacaacatcaatgataacaacaatataaacttttatcatagtaacctttcctcaataatgacttcaactcaaagtgagcaataagcttaaataacccccaggacactgtcatcactgattgtgtctttctagggttgaactgtcaattcaacatattaggcaaagcagcttaccaattgctgtagttaacacgaatacttgctccatcttttttccatcattgtaaaacgccagataccaaggtccttgatccatatactctatgaaacctgtctcctgaagcgaagttaagatcaggttccgaggggagtgctgtgtatcatcagagcccttggagtcctgcttgaccagctgtttgccatccattagttttacaaaatcaaactggaacaaatacaaacatgaagatgagccactactttttcttctagactgataaacatccctaacttcaactgccctatttcttacttctttgctttgaagttgagcaaattggaagaggaggttatcaatttttaagtatatttagacttggccaggcacggtggctcatgcctgtaatcccaacactttgggaggcgaggacaggaagatcacttgagcccaagggtttcagaccagcctgggcaacaaattttataaaaatttttaaaagttttttaaagagcatatttaaactcaaaaacatattattaattatgaagaaaccctcactgtaattaaaaatattataaacctttcagtttgagagtattcaaaataattgtttaaaaatgaataaataaaaaacagaaagaaatcttgtttagtattatgcaggagaatcttgacattttactaaagcatctgatagaagatacttgaaaatacaccttccactcataaatgttactgtgaccttctctacaaattaaaaacagttgtatagtctttaaaataaatgaacagtcaaaaatttgagaacattcatcataatttactacgtttgtgggtgacatatttacatattcaaaaggcccctcctctccattttttctaatcagttgacaaggacctggcacatgtttccttgaacatttattttttgaatcacatttgaatgcattctaattccgtttctattctggcccagaaggtaaggttgttttttagtttgtttctttgtttagcatgatctcttgactaactgaaggtaaggttttaactatagtcatatctgttggggaaaaaacaagccccagtgtttgatcactttttctacttcttagatgaagtagtgctcgaaatgggttcatgtggggaaaaaataaggagaagaaaataagagaaatgagatgtttaaagtttatggaagggctataaaaatcatagaagttttacacatttaagttattaacaacagtaaagaaaaatttctacctgtaagacaaaacctaactttttgactaatttctcactaatttctgattaatatgcgttccttcattgggaaaaggggacacagatgtatgaaatcagtgaagggactgtgggcagtaaagctaagcaagatgagaggtctgggaagctcatgaacagccggttccaggaagcagaagtcaaatttaaagggtgtgtcttaaactttcttttctgaatctgctctgctaaatgttattccttatttctccatgtcatttttttcattagtttcagtgtaattattctggatatttattcatgacaaatatttttctgtccttacctttgacaaccacatatttcataagtcacaaaccctgaactgttcaacccatcacccttgaaaagggtttaagaaaatacctataatatcaaatacctgagtatgtgtaggtggaatgtttcttctgccataaattcccagcagagagtccttggctaaagaaatattgaacttcagatatattggatggtggatagtaatctggaaacgccagaataaaccaggtggaatggtctgcatgacctgtgcaccaatgtcaacttctccagtgtctatcgcccgtcccttctgaaacactagttttaaaggtagagaaaattacacaccatgttaatcttaatttataaagcaatggtttttagcttttcaagaacagatatatcaaaataacttactcagctttttcttcctccccaccccatctgtctttcaaggccttgcccaaattaaatatcatctaagaagccttccccaaccacccactatgtcagtctctctcttctcttcaaaccctattgcatttatttcaatcaatttcactccttttaaccattatttactgagtgctgtcttggtagctgcaagagatacaaagatgagtaagaggcagttgttgctctcaaggagcattgaaaatagggaaaataggacaagcacatataacctcactgtaaagaaaaataagtgctctgtgtatttgaaagagggaaagttatttggttggaggatactcctcatctctagctatctctatcctctttatcttcttgtatttctccttagcacttatcaccatctaacatactacatattttacttatttattgtttattgtctatttttcctcaatagaaagtaagctctgtgcggacaagcactgtggctgttttattcgtcggtatattcccagtacctagaacaatgtaggcaactgtaggcaaagaacatagacgatacatatgtattcatagaacaaatggatgaatgagaaaaagttactatgggaagtggcactgaagatgagccttagaggaggacaaggatttcaaaagagttattgggaagagtggcgcacatggaaaggatggcttgaactaaaaagaggaaagaaactgtaaagctaaggtgtagggtatgtgtctatagagaggagcagttggagttagggctggagggaagaaggaaatcatgttgtctagggcctagaggaccagtcaaaagggtttatttaataaaggatagaaagccattaaaggtttttcagaagagggaagaggtttgggtacattagaaaggctaatcttgaggcagaggtgggacgaattagagcagacggacacaagaatgacataggaattatgggtgattcaagtgaaatgacatgaagatctaaatttagggtatgcccaaacagctcatatagaaaaactacatctcagtgaaaaataatttcatgtgaatggaaagaaggagaagatatgagagacaatgctaaggaagatactgcagtagagattctcaaactttaatgcgtacaagaaggcagttttttaaaatacaattctgattcagaaggtccaaagtcagacatttttaacaagttcccaagtgatgcccatgtcgcatggtctacagcccacaccctgagaagcaaagctctagagaacattaagtgttggggccaatggagggtcaaagctaaccccgtgattgtgagttgggggatttagacagtgctaatagcaaaaacaggagctggtctgtgagggaggatgttgagtttgggcaatcagagctttattatttattgtcatattttccaatgatttctgatgtgccagtttaatatgtgttttcatggaattttttgttttgtggtaatggggagggtaggaatacaagaggaggagcaagatttagtttgccttgattttaagcaaggagggttacatctcaggtgagaaagctcaacttggcctcatttcacatcacctttatttttttcagccatcaactccttctccagaccaaacacagttttaaaacacacatggtctctgttctttgtgctcacccattataaagttaacagcccattaagaaacacacctgcagtggctttattcagtggccaatgccttgcagcttttaactccctaaaatacctccattattgctttttgtgttaaggccaacagtaataactattttaagaatgttcactgttaactgttaataatagatttcaaatgcaattttgtacataattatgtattacaggacacataattttgtggaattgacatttataataaaataggctctttgaaatgataaatgaccaactgaggaccttatttttcactgaaagttacttttttccatgtgagacagatcaatttggcccctaaagggctgattatacatttaactcttaagtcctagagctgacaatgtcttcaatgagcagacaattaacagaccatgtttatgtggcacttctgttcgcaagttaatgttcagtttattcaactgctatcctcattaggggcttttatcaatcttaaaatgcatcatttggttatgcaaacaatattataaatataaaacaattcaaaatgttctaggtttgacaaacactgttttaaaggtgctaagaatagactttaatgaatagatattgtcattttttaaaaatctgaacaaaactggttgatggacattaacctttatattaaaaccttaccaaatactacaccatctctttattctgcactttatagcatcatatattacataatgaagctacttaaatgttattcaataaatcaaaagaaaggaagttgtgttgttgggcttctctgtttattagcaagtctatgtatctggagtacatatgcataagttattcatgaaaataattttaaaagaagttgatctcatcccttgaaagcttcattacagctaagacaaggtagatgaacagagatgacaacatacgaatgagcacgtggactgtaatttaaataaaaataggcaaagcaagctagttgtggtgatttggtattagagaagagacattctcacagcttgtaggtggaaaatttctcagcctcttaccctttagagtttcatgcatcagaaaggaagatatttccctgttagcaatctagaccactaaatagactgctccattttatcatctctcaaaatttgttatagactatagtacaataactatgaattcattatttaactattttccttaatgtagccaaaaggtgtggcaaactaaagagaaggaaattaaatgtagaaaaacaatacaaaatagtattttttgaggccaggtgcggtggctcatgcctataatcctagcacttcgggaggccaaggcgggtggataacctgaagtcaggagttcgagatcagcctggccaatattgtaaaaccctgtctccagttaaaaaaaaaaggattttttttccaaaaatttctgtattaatataggtaaatgggatctatttggccaaacttaacactgactctgatcctttgtttgcaaattgtaaacagcagagatagaatacagcatccaggtacaattttatttatttttgcaatatgcctgttctaattggcatttaatctcttattttactaaagcatactggaaaacctaggaagaccatattctccagttatagaacacttccttgcacaaatttgagattaaatgcagagagccacagatcatatcaagctgtgcagtactgtagttatcacagtctcaccaatatccaccaatttagtttgagctaaacactctctttataggttgcaacacaggcatcaactgctgagcaggaaaaaccaatggtagacaggctgtgttgaaagagggcacactaagtgatggtaactcagttccaaaagaaaaggtcaagatacttggaaggtgaaaaaaaaaggggcctggaattggtgacagacaatgtgtgcagtggcggtatcacctaaatcaagactccattatatctagactcagacacacacttgaatactaattacatgattactaatgacattgttcatataaaataggaggtaaataactatattctgcacatatgtgtatatttattttttctatttaatatagctagacgtggtacattcaatgatcctatgcaaaactcggttgaatattgatagaagatagtgaaacatggtcattaaaaagattccaccattacattttaaggtaaaaatgatcaagttaaaggctatggtatagcccataacagcaatctgagttgtattttaaagacatttgcaagtttcacaaagtatctaagctatgttttccaaagagaagaaatatatgcattcagagcatatttgtcctttacttcaccctataacatgctcaaaatctttaaaagatattggtgtgtttttcagccaaattagacctagtgtgtgtctcacgatataagtatcatcttctttatgttcctctgaatataatacttgtttaacagtaacaagtcttcgcaaatttagattagcagtgcttggagcaaaatgggaggtggaactaacctcttccctgtgattaaatgctttaaagggttcaaaggggtatagcaaaagccatctgaaaggtaggtggaaagctactgtttccatctatgtagcttaatgtaattttccttacgtgaactatcgaagagaaatatgtattcaactctcaatttttcaggggtagattttctgggttatggattacacatgcttttgtatccattatattacccaaaagtagtcaagagaaaaagaaaagaataaaccttgcgcctggtgggaacttggtaaacactgcttggatacattaataaattagtaatgttgataatttttttgttgatagtaattttgataatatatttgacattttagtcaaaacgtacaactttttttattactctcaactatgtgataggtaggtcatcatataattgtttttattaaatgtccagtaagtagatgtcaagaatttactggtgagaggaagaattataactatttacacacataggccttggcaattaactgtgaataaaatatgtttgtaaataaaatcctctgatatgacactgataatagatagctcactgtgtagaaaagttaattaactaatcttacaattgagaaatacattacttgtataagtgtaaacaattatgtccaaacaccaaaagactacagataccagtacagtagcttatttagtattgcttacatcttctcaggtagaagtaaaatggcattgctaaaatcttatccttaattaaaggacttattttgagttgcattttgactctgtatatctgtttttgaagctatatcatttaaaagacacaattctctatttagaaggatttctttaaattttgttgtaaaaacttccacattcccaaaaactttagtttcacagttcttctggtgtggtctgttgaccattaggtagcattcagaaaaatgagtttccaaacttaaggctcttgtgacttgctatacaatctcacacggtgtaatacaaattacatttgtagacgtttctgtatacggattacaaatgggtacatgaagtagccaattactttgacttttcttggtgaaaactaaaattgatataaagcacaaatgtatcatcaagttgttacatattcaaacatttactcagactcatgggtcaaggtggaataaaatatctcttgaaagaaaatattgccaattgcaaaaaaatccaaagatttatgaataaatatgactatatgcaatgaaaactccaaagtgaaattaagaagagaatgtccatttgtaatatcattaaaaagaataaaatacttaggaataattcagtaaaagaaactgtgagatttgtatactgagaaactacaagacataattgaaagaaattaaatatttcctaagtaaatggaaagatatcctatgttcatggatcaaaagacttattattgttaagatggcagtacttcccaaattgatttacagattcaatgcagtccctgtcaaaattccaactctcattttttttttagaaatagacaagctgatgctaaaattaatatggaaatgcaagggactcagaataactaaagcaatctttaaaaagaacaaaattggaggcctcacacttcctgattcaaaactgattacaaacctacactaatcaagataatgagtactggcattaggatagatatatagatcaatggaatacaactgagaatctagaaatgaaacctcacatttatggtgaactgattttcgacaaggtcaccaagacaattcaatgggggaaagaataatactttcaacaaatgatactggaacaactggatatccacatgcataagaataaacgtgacccccttcctcataccatatacaaaaaacaactcaaaatggatcaaatgcctacatgtaagggctaaagctgtacaattctcaaatgaaaatacaggcataaatctttgtcaccttggatttgtcaatagtttcttagacatgacatcaaagcacaaataacaaagaaaaaaatacataaattgaactgggaggccgagacgggtggatcacgaggtcaggagattgagaccatcctggctaacacagtgaaaccccgtctctactaaaaaatagaaaaaattagccaggcgtggtggcgggtgcctgtagtcccagctactcgggaggctgaggcaggagaatggcgtgaacccgggaggcagaggttgcagtgagccgagatcgcaccactgcactcaagcctgggcgactgagctagactccatctccaaaaaaaaaaaaaaattaaaaacttttgtgcttcaaaagacactatcaagaaagtggaaaaacagcccacagaatgggagaaaacatttgcaaatgatatattggataaggggcttgtatctatggtatattaaggaggcttacaactcaacaataaaaagttaaataattgaaaaaagagcaaatgatctgaatagacatttctccaaagaagacagactaatgaccaataagaacagtaaatgaagcttaacatcattattcatcagggacatgcaaataaaaaccacaatgagataccattttacacccattaggatggctaaaataaaaacaacagacaataacaagtgtaaggatgtggagaactggtattctcatacattgctggtgggaatgtaaaatggtgcagttgctttggaaagcagttcatcagttgaagaactgttaaacataaaatgttaaacacagaattaccatatgaccccgtcattccacaacttggtgtatactccaaagaattaaaaacaggttttctaataaaaacttacacatgaatgttcatagaatcattattcacaatagcccaaaagtgaaaatccacaaaagatctatcaactaatgaatggataaacaaaatttggtatacctatattatggaatattattcagccataaaaatgaagtattgatacattgctgtatattatatgattctatatgaaatgtagaaataggcaaatctatagagacagtagattagtggttgccaggggttggaaggaggtggggatatggagtgacagccaatgcctatgaggtttctttctgatgtgatgaaaatgttctagaattaaatattggtgattgctacacaactctgaatagggtaaagatctctgaattgcgcactttaaattagtgcacaattatattatgctatataaactatatctcaataaagctgtcacaaaaatacagttagatagtgtgaattggcatagcatatacacaaaaaccatcatgtactgtcacaagagttttgatgtatttccaagtggttttagaatgttacctgctacctagaagctgaactatcccctggccagtattttagaatgtgtgattggtagtacacatcagggatgcccattttctatatttcatacaatgttagatactgttatatgtcagttatcattatcacatcattcttaactttggatggtggcaggatggctgattatagctcagttaatccagttccctctcctttattttagaatataagtccccagaggatagaacattcacatctgtctaaattttcgacagctactcattgggcatttaataaaaacaattatatgatgaactacccatgacatagttgagagtaatgagggaatggcatatcttgtactagtcctccagacttgccatattgctatagcctttgatttctaccttttaggcatgcagaaatcttcaattacatgaattaaaacttctcacagacaaaacccatgtcagagagtaataataataataatagatgctaccacacttactgtgtcctctttttcagttcctatctcttatttctaaaataccaaaatgcctctttcatactcagtatgccatccaatttgatgtcccagtttatctctaaggctcctccctcctcttctctcctgcttatgctgggactttggtctttttgcaatcttctttcttactcatactcggtgtctccctctctattggctcctcattctttgtcttcaaacaaacacaagtctctcgcagtggctcacgcctgtaatcccagcactttgggaagctgagacgggcggatcacaaggtcaggagtctgagaccagcctggccaatatggtgaaaccctgtctctactaaagatacaaaaaattagccgggcgtggtggtgcgcgcctgtaatcccagctactcaggtggctgaggcaggagaattgcttgaacccgggaggtggaggttgcagtgaaccaagatcgcgccattgcactgcagcctggacgacagggcgagacttcatctcagaaaaaaaaaaaaaaaaaaaaagtctctcttcttttgaaaaatttgtaaaaaaactaataacatgacccaactgcccttttgtcaaattatcatactgtttatctccttcctttccttgctgaactgtttctatcagctgcactattgtttcattatccacttaccacctaggctattaccatctgcatttcccccttaccattcgattattccattctcctaaaaatgtactcctcaagatcactaggagtgatttttcttgttttccaaggtctggcgcaaactacttctccagaaacagtcgtattttaatcttctttcttttaagcctgttaatcacctaaccatcttatttttatttctgtacaacagtttgttgcatgttgtttgtattgtatgtgtatgtatgcatgtttcttccagctctcctatgtaacgggaatctgctcaagggcaagcactatgtcttctgttttatttgttagctttccacagtacttagtacagttaaagtagcagcttggctgatacaggattaaaaattatgagcttctgtgtttctgaatactaagaatttcatttttgttcccttgctattagtttaatggagcatttgaggtggtcaggtatggtttctctttcaactcaactttttaactgttattcttccctctcctagaaccaagaagagaagatggtatctgtgtatagctgtggctgacactttcagtataattataatgaaaatagaaaatgaccattaaaatgactaagggaaaatggaagctacaagaagaatacagaagtaaacgcaaggactcttaatattagacatgtgtaggctaaaaaagaatgtgtgattatcatctaggagattacaaaagttacacgcaggaaaaatgcagatttgtgcattaaattctggaactgtaaaacttcatagtcaaaagtaaacttcaagtaactagaattacattggactccacaaaaaaggctagtaaatgtttaaacttccttgaaaagtaatacaggttcaaagatataaatggatactcaacagaattaaatatacacatggctgataaacctctacaatggactagctcctccacaaaactaaaatgttgtaaaaatgttatgggaagatcccttagctttgaaaggactagtccaggaggataaacatggcattctatagcataccacttagtgaccctgtcagatgcagactgttagactagagggaccacaagacagacctatttcttactgcatcacaggaaaggtgtgtattagtttttttttttttttttaagtaaaatgaggatgaaaatgaaacaagaatgaaacactaaacatatatgaccaaggacatttaacgtgaatttttaatacaataaataagtttgtctttcagcatagggaaccctttccataaatctgttttagaagtcaagtctccagtatgctttaggaaagcttttgttaaaactgaagtatattgataaagtgatttaatatagttgaaaacaagctgcagcactctagctgggccctctgaaaccttctgttagggaaacatctatatagcattataggaaacatttactgtaattcgccatcaatctttaaaaataatactgttacactcccaacaatgttgtctttgttagcgcattacttctattttattcatgtggtttgttgtgcttacatgaattattcccaattctacctcaatatcttgggctataatatcctttaaataaaagatactgaaactatgggttgactcaaagggctgctgaatatccacatgtcctatgaaccaatattgcagaaccacagaattatactgcaggactgcgttccatctgaatgcacaatgattacctgggtggggttggtgcagttttttagtttggtaccacataatgaatctttatctactgattgggtctgtgaaataaatatctgccaaaccttaagtaaattaaaatttaacctgttatttcaggtccacaattggcattgtataaaatgttccaaggcatttatgtctcagataaagcaaaagaaaaaaaaaaaaaaaaaaaaaaaagcaaaacacacacatacacacacaaacacacccctcttctggataggtccacaatgaaaggtggctgtaaacagtacattttgcactgtcatttagttttcaattcccaagagtacttgtggggtgtgtgtgtgtgtgtgtgtgtgtgtgtgtgtgtgtgtgtgtatcttttgctttgtggaggagggagaatgctcgctgaaaggagatcttagatgtgaaatataagatttgccaagtactcttaaggaagagtacagtatttgaactgtatgcattgagatttttaatcaagatagccgttatttaaacaaactggctttgagaaaggaatttttttgaaaaatgaaagaaaaagcccaaggaagggtgctaacagtaaggagaaactggatcacaatctcagctctgcctttagttatgtctattgtctattgcgcaaggcaagtcatgtaactttcttgtgttttccttttcaactataaaacatgggtaacacggctgggcgtggtggctcacgcttgtaatcccagcactttgggaggccgaggcgggcagatcaccggaggttgggagttcgagaccagcctgaccaacatgaagaaaccctgtctccattaaaaaaattacaaaattagcctggcatgatggcacatgcctctaatcctagctactcgggaggctgaggcaggagaatcgcttgaacccgggaggcggaagttgcggtgagccgagattgcgccattgcactccagcctgggcaacaagagcaaaactccgtctcaaaaaaaaaagaaaaggtaacgatagctgccacagaataaaactattatgtggataaaagacattaaagtattttacaattgtaaatgctaagtgcaagctgtgttatatacatgtcaaaactccaaacttataaggtaggaaactgggaattaattgtttgaattgcaacggaattctctgcaagtattttaaatggcaaatgtggttttacaaactttatagatatacatttcaacctctttccaggagtatatcccttttgcaaaaataggtccacttttacttgtattggctcattattcttccttaactgcagaatttgaacactaacgcatagtgtgtacagctgaaagggatcttacagataagttagccttgtgttttgtcaaagccttagcagctgctgagagaatagagggcaaataaagcaaagaggaagggaacgggagttttgccaggaatctgcccccttccctcgccatatctggagaaacttggcttttatctgttttctatttaaatttgtaatttctgggtaagatttaatttgtaaaaacgttttcactgcctgctagccccgcctcttctctgcccctagaaacggttgaaagccaactcccttatttttcagatgagaaactggagcctagagaggtgaggcagtagtcactatttggtcttggctaaagcatcttcatgacaggctataaattgtgtcatatcaatcagctgtattttgtttacatggtcatatattcagcagacactgactagaaaaacgtcattttttttcaactttgtggagatagattgtgcaggatgaatttaaaagaaatgccactttcccccaaggccaggcttatgcaaaattgtaatggagataaaggctgcttttagtattctttagttctgtctttccccacccatccttctttgttcccagtgttctattttggcatccaacctgcaggaattcagtatcctcaactacccaataaatttcatctccatttatattgctactgacaatacaagactttacctgagccttaatgctcctggaaaacaattttgcttaagaaattccccaaccttttgttttccgaaattctcccacttttttgtgtcctgggaaatggcttatgcaaaaaaaccgtaacaatgacaacaaacaaacaaaagtccaaacaaacacatacaaaacacccttccctaaatgacttaagataaaactctctgtcccttctttcccatgatttccctaagactcacctataattccacccctgaaaagaccaaacacagacttttcccctattgcctgaacccactgaaaggccgtatacagaccctccaatttcctattctttgtctcatgaataattagttgagattagaactgtctgtttccctgaaactagctagaaacaaagatacacatttcctgttcagctaactgatacttcccctgattgcaacacgatcccaccagtaaatcatctcacatgtaacccatctaccccttcctaataagaccaagacaaacctccctattgcaatagcctgaataaaatcaattgttttacttgttcagtttttctctgtgatacttattgaaaaccttttcagaaatttatatacttagtttatcctatactattacaataacaggtgaaaaatataaaacgtgaaactcggtaccttctctcctagtcccagctctttctatgtgatctcaacttttctggacctaattttcttaatttctaaataaggatattggatttgataatctttaagattttaacattctaatttattgataaattacgtgggggtagttatttttaattttatttatagacattatataactcaggtctaggaataagtcttttatttgttcatatcctctgctctgtttaaagcagttgttacataatgtttactggttaaatagttataggccaggcacagtggctcacgtctgtaatcccagcactttgggaggccgaggcaggtggatcacttgaggtcaggagtttgagactagcctggccaacatggtgaaaccccatctctactaaaaatacaaaaattagctggatgtggtggtgggcacctgtagtcccagctactcaggaggctgaggcaggagaatcacttgaacctgggaggcggaggttgcagtgagccgagattgcaccactgtactccaacctgggcgacagagtgagactccatctcaaaaaaaaaaaaaaaaattatgactagtttgtaagactctaatgtagtgagggactattttggtacaatactttcaattttataaatatttaatactgacaactgagatttttctggtagattacagtatgtggttgtgacttatatctgcttattgaaattctagagtgttcgtaaattttttagcatactaaatgtctataatcaaatactctttttctttcatttggataactaagtggtgagaaaattctgttttctcatgagaagcagatatataatatatatatataacaactgttaatgggaaaccaattccagtagaatttgatgtttctttaaaaagtgccattcatcgccattctaactggtgtgagatggtatctcactgtggttttgatttgcatttctctgatggccagtgatgatgagcattttttcatgtgtctgttggctgcataaatgtcttcttttgagaagtgtctgttcatatccttcacctactttttgatggggttgtttgtttttttcttgtaaatttgtttcagttctttgtagattctggatattagccctttagaatggcgatcattaaaaagtcaggaaacaacaggtgctggagaggatgtagagaaatagaaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttactgcggcactattcacaatagcgaagacttggaaccaacccaaatgtccatcaatgatagactggattaagaaaatgtggcacatatacaccatgaaatactatgcagccataaaaaaggataagttcatgtcctttgtagggacatggatgaagcgggaaaccgtcattctcagcaaactaacacaaggacaaaaaaccgaacaccgcatgttctcactcataggtgggaattgaacaatgagaacacatggacacaggaaggggaacatcacactctggggactgttgtggggtggggggagtggggagggatagcattaggagatatacctaatgttaaatgacgagttaatgggtgcagcacaacaacatggcacatgtatacatatgtaacaaacccgcacgttgtgcacatgtaccctagaacttaaagtataataaaagaaagtgccattcatcattatctgatgatgatagtggtaacagtttaaaaataataggttttagattggtgagtagagaccaaactttaaagagagaaaacacttcgatctcaagaaggtcatcattcactgcaaagttcatagtggtttgaaagcaggttctatagcacctaacggaatgtcaatgaagttcaaaaacctcaaggtgattttccaatcttttggtccgataataactgctgctaaattaagcaatgtgtcagacactgtgctatatgctttatatcaattgtttaattaactccttactatgaccatatgagacaggtactattattatcacccttattttacagatgagggcactggctgggcgaggttgtgtcaattacttgaggttggagagataatgatggtacagttagtatttaaagccaggtctctctgactccagaatccaggcttttaaccacagtgctataatgcccaatcttctaggagagtagagaaaacaatttaggaagaatggtctggttgtcagtttcatattttagtgcatacagtatcaggacaagcttctagagctgtatttatgggatgtgtcttatgtagaaaatcataaaaggatacaactgaacatttgaaaatatccttctactgtattatatcttctgcaaggtttggattagtatacatatggcattaaaaaaaaaaggagctatgtttttacttggtaagtaatatgcagtaaagacctaatacagcaaaaccatgatgtgcagttatagttaaggttttgttcaggcttccagaaaaagtcaggataagctagcaacttggtatatgaggcatcaacccataatgatttttcttaataaagtatttaattgaagtcggtttgctctgtttgttgttataattgagcagaaacttaaatcatttttcatttatgagacttgtcacaacacattaaaaatagaggtgagtagaatttctctaaaatctatcacgaatagactctgggactttgctttcattgtgtaaaaagttttttgtggtcttcacagatattccatatgaggattttagtacagtgtagaagttaagagactggactctggaatcagaccaccacttactagctctgtgacactgggcaagttacttaacctctctgtgcctctgtttctcatttggacaatggggaccataatgtgaccttcatgatataatccatgtaaagtttctggaacaattcttgacacgtggtaattttaatttaattttagccatcatcatcaacttactttatggaaaggaatcaaaagaggtctgaattagaatataaaatcaaatatactataatgacaactatgtgatgacctgctgtcttgcatgtttcattttcctcagacagataaattctgatttttagtgtgaatggcaagaaaccctaggcagataataccaaatgatagctcttgtactttcagatataaggggataaaacagcagaagagaaggtaagggagaaaaagcaggtaagggagataaggaagaaaaatctgagcagtgagtgtggcagactttcttatctgccacctctgacccctctactctcctcagccactctcaggagtaacagtgaaactgctgggaaaggtcactccaggctagaaacaagtattttgaaatgagaacatacagcaaactgcatcatgaattgaaaactagagcaaaccataatattttcctgaaccctaagcattaatttttactgaagcatggattacagttaccttttcaaaagcacacaaaaacaagaggaaacaaaacccacaaacaacccccccgccaccacgaaaggaattaaaaacacaagggaagagtagtaacccaaataactactgtattaaaaaatgatgtcttagttgcaactaatgaaccaaaataagactgtgttaccacctgtataaaattgtaagcttcttggaggtaaggttttggtcattcattcatttatttacgtttggtctccaaaaattactcaggatattgctggctatatatattattctcaatttctaccgtttaaattgacttcctggaattttacaaggctcaagtccctctgtactgaatcctatttcaataaaaatataaatttccagctattttcactgcttgtatattaagactaagatcattcagtgtgaataagatgttgggagtgctggtactgtgacatttattataaataagtcaggtagttcaagctcatgttggttaaacttaacagttcaggactcaaagtgattttttttttctttctcccaactaggaagaattcatgttcccaaactagaaaaaaatcatgttatccaactttgacataaacattcacctttacattaagcagaaaaagctttttcgtattacaaacagaagaaatttccatataccctttgtaaaatgttatatataaatgctgggcttggacacagagaatgtaatcaaaatcccacgttgcttcagggtagttatatgcgaaatgcaatttccattgtattgaagcctccattctgtaaatatttatctattttcaaaattgccaacatatttgaaaactttaattggtttatactcaaggcactggaaacaaggaaaatttgctttcacaagatatttacatgcatttattctgtccacgtagaggacttctttcaagtgatcatgaaatttaatgtgaagtgaaaccatcccagctacagttctaatgaccaaattagaagaaaagtaatcaacaatcaatcattttgatcactgtaccttttttctctgatttatcagaaacttttcctccaattggagagtaagtagtgtccatggactcggtccccctgttccctttgctaactccatttgcatacagctctccttcaactggttgcaactgccaagtcaggccgaacaaatgcactgctgcaagagaacaagccatacattaatttattccagactcactgagaacatctccaagccaggtatccctttgcacctaaaaatgttacgaacagttttcttttagttaggccaagtaactgggagtttatacctatacatcatacatgtagctacttacatgctacgacacacatataagtgttaacagctgttaaagtagctgttgttaacattttgaggctaaagctatcccaatgataggattagaaattggaatcaactatagtacaattagacttaacttctcactgctgtgaccctttccttttccattccccttagtcatgtaacactagtttccatatggaaactattacagagtaatggtggacagactaccatgagaacatggaagaccttctctatggctttaattcaattcagttcagcaaatatttcctgaacgcctagtatgaataaagccctatgatagttgctgccggtgttaaaatgtagatgcttattagggtgggatttggtagtaataccaggataaaataatattatgcagaatgattgacataagacaggtttaaactgctatcagaagattaaaaagtacccagtgttggtcactgtgcaggaagatgggcactctcatacactcctgatgagagtataaaaatacagtgaccttttttggagggcaatgtggcaccatttattaaatgaacttaaaatctgatttaccctttgagctaacaatttaatttctgtgaattaactatgaatgttgccaaagtacaatgctgtctattgtaacatctgaaaacaatattagaaagttatgatcaatctaaatattcatcaagaggggattaatcaaataactgatgagatagtaaataatacaagattatgcggctgctaaaaatcatgttgcagaagaccatgcaatggcatgggaaatattcataaggtatcaaatgaaaaacattaggctactaaacattataaatagtgtgatctgaagtgtgtgtgtttgtgtatgtgtgcacatgttcatgtctggagaaaaaaaggtttggaagaatatatagcaacatgttaacagcatgggaagcttacagagaatttttattttttttatgatttctgtgttttccatattttttttacaatgaacatgtgtaacatttgccatctgtgaaaaagaaagctttcggtttaaaggaacaggaggttaaaataggttgggctgatcaagaataatttttgaaggaagtgggagtagatatagaccttgaaggatgtgtagggctttgacaggtgacaacgattggtggggagaagggacagggctgaacaaaatatgactttgtaaagtacatgatgtatctgaggcaaaagaagttgctggggttcactggagcttagctatgtgctggtgccagtggaagttaacgccagaaaggaagattagagccatattgtggagcacactggtgccacacttatacatttggattcaacttattaggcaacgcagaggcatttctattttttgacaggttgagtgatatgatcagaatttttcggatgattaatttgagagtggggagcactgaaggtttttagccaaataactgatataataaaaacatcctttgcagaaagataaatccagtagtagtatggagaagaatgaattggagacctaaaggtttggcaaataaatcaattgggatggcattgcaataatttaggaaagaagtaattagtgccccaattagagtagtgtcacaggagtgtctcagttatttgcagtgggaatgcaaagaaggagatttcttaaggagaaattgcataaatggcatttcaggatttggcaagaagtttctttctctctctctctccctctctctcgctttctctgtctctgtgtgtgtttgtatacacattcatgcatgtgtataggtgtgctgtgggagggcgtagaaaaaagtgagagaaaggagggaggaatccaaaatggttaaggttttgagtctaactgaaacaatggtggaaccattaatagagttagagaattctttattagtctagcacttgctacaaatagttggtactggatttgtgttttgttgattgatgactatttgaatatgtggcttgagacaggatgagaagatgcaaggaatgcaatgaattcagcctttggggttgttgggtgtctgggactgatgggccctccagatagtgaatgctaactataggaggtttgaagttctggaggatattagagctagaaaaagaatgaaaagtcatatatgcacagaggcaatagttgaagttgtgagagtgaatgaagtcactgaagggagagaatgttaggagaaaacagttcctagggcaaaaagctggagaaacctcttgtttgttttctcattgcatttttcaacatcaaccaaatcctatcaaaaggcaaaaaaaaaaaaaaaaaaaaaaaaaagtgaatctgctcataagccatttcgtatttctctttgtgttcctaggtgaactgaaaggggctaattagtatgtgtaacactcatgtatagtatttgagttagtgaccgagaacagagaaggatagcctatttaaaaatcattcatccacttttagttggagctaaagagatttctaacacctacttcctaatttatccttaaaacttttaagcatttaactggtttctacccttttctttggattaaggccagtgctgcctgatgaatttctcttgcaattattggaaataattttaactcaaaggatagtggttctgagtaaggtatggtatggcacattaataaagctatattagtgacatccttgagatttccttgccaatggactctagtttaacacacctgttccaattagaggtatttttccgttttacagaaaatttggtctactctgcctcccaaataatttgaatatgatggatagtaggagctatattgaaaatgtgtttcattccctgggttcaattacttctgtgaaattagatggaccatatataacaaaaggaatagtagatctcatttagaagactaagggggctattttatatactttaagttgagccactttcctggcggcacttgaaaatgcgagaaaatgcatgtggtgagattcacttcaaaatatataaggtaaggattaatttttcaccatcgaatgaaatggactgcttccagccaatcaagacagataaagaggtatgggcacatttagtagaacactctttgagagcagtgaagctttgtaattttttgaacttactatatctttcccagggaacaagctgtttgtaatatatgtttgtgtgaatatataatgaaagttaattatttgctacagaccacagacaggtatcatggcaaggctactggccttttatttcttccaaacataggtactggccaaccaaaatggctatcagatataaacaactaatacagtctaaccagtgtgtacacactggctgaatgtcagctttagatgcagtataaagacagcttccttagtttctagtggattcccatccagatttatgctatgtgtttagagccacactgtttaggtgagtcccccaaacccaagaatagacattatgagccaattggctagaataagggtaaaattagtaatgaacaaacagggcaatattaagtcatattcacatgttgattcaacaaatacttttttgagtgcttactttaaaccaggcactgtttttttttttttttctgagtttacagcagcaaaaacataaaaaaacctctaccctcccagaacttacatgagagggtagtgggttaagacaggcaaataaaaaatacacgatataaaatataagatagaatacaacgttaagggaacaaaccaaaaaacaaaaaacaacaaataaacaagataacgttgggtagttataagtgctatgaaggtaaaaataggtaagggtggtcagagaaggcctcttggaggaggtaacatttgaaccaagattagaatgaagtgaagccattgtgaatatctagtggaagaatcttccaggcagacaaaacagaatttatagaaagccctgaagtcttacatgaagtgtgtgagaaatactaaggagcccagtgtgagctcagtcagaaaggcaaagagtggtaggaacactcatacacataagtcctggacccataatcttgttacctcagtacgctagccaactttgcaagctggtcaccaacaaataagaattagaaagtaataaacctaaaatctcacataccagaatatatacctccaaatgagcactgctggttgaagtagatgtaatataagcactcttgactgtaagcaaggtcaaagttactgttccctaagacatatataaaatatatatatatatatatatatatatatatatatatatatatatatatatatatatactcaatgaatggagatggatgctacccagatctctgagggagtacccatcctgttatttgcatttcactgaaattcaatggttggacagaatgtttatgtctactcaaatattccaggaatggtgtattttcagcagattaaaaatggcagtccctaatgctcttttagcaaatgttccctgatgctgagccctgtacattttacaattattctccttccttttctatccaattgcaaagagctgtgctctaaaattataaattcattacaaagttcaggtaatgaatggattgtcttggctctcctcaattccaaattcaatcaagcaccttggaactcaaggtaggctgaccccatgtacagaagctcttcctcttcttaacgtacacatttctgtagcaacctccaagtctctctgcagttttctttctgcgtactgttagaatgttggactatgtttctcataaataagactggtggtctctagcaacatttataatcaataatcctttcccatcccactctctttcaagaggcactcattgactcaaaaaaaaaaaaaaaaaaatcccacaggaatgcgtcagaagtaaatgtgggaaatacatgctgaataacttaggcctatgctatccaatatggtagccactcatcacatgtgtctgttgcacacttgaagtgtggctagtcagagttgaagacttgatataaaagaaaaaatataaaagatcacattaatatttttatattatttacacattgaaatgataatattttggatatatcaggttaaataaaatatttatttaaattaatttcacctgtttcttacttttttaatatggctactctaaaactttaaattacatacatggttcacaattatttctgttgagcagtgatgatcttggactacctacatttcacaaagagatatgatgtttctcttttagcaccctatcatagaatctaccatactatattaaagatatctgtttacatgtctgtctcatcattattaagcactccaaaggcaggaacaatgccttctgcatttttctgtttctggtacctaactctgtgattggtagtcaggaagtactcttcattgctgataggagtgtacagtggtaaagtggctttggaagacaatgttgatatctatcactatttaaattgagaatattccttgaccaaggaattctacttctaggagtctgtactaaagaaataatcacatgtggggcataaaggggcatgtgcaaggaaattcgccattgcattgttaatatattgactttattaatgtagttaaaaattagaacaaccaatatacccatctatggaagagtggtacacgcttactatgaaatcctttataagaattaaaaggactgatactgagaaattatcagattgaaggaaactaaggagacatgatgactaaatacaatatggggatctagaaagaatcctgtaacagaaaagactgtggaaaaactggagaactctgaattaaactctaagtttagttaatagcctcataccaatgttaatgtcttagttttagtaattgtactatgtgcaagatgctaatattgggagaagctcagtgacaggaatacagtgattctgtgctatatttgtaacttttctgtaagtctaaaattatttcaaaataaaaagccaaaaagagagagaaaaaggactgatcaagtgatatgctggagctggcttatactggtttacaaaagccaactgtgcacatctcttcccaattccacctccaatgactttatattggcagttgaaattgaccatggcaggtgtatttacatcctgggaattaggaaatgtggcagatcaggctttttgggccagagagcttgttaaacatttatcaacacatcactggatgatctgtatgtactgaaatgaaacaagctctaagattttatgaaaaatattgtagaacaatgcatattctacgatctggttttagtagaaaatatgtatttatatatatttacattttttaaatgcatagaaagagacctgaaaaatgaataccaaactattgatgtttagagtagggagctgtgaaaaccaaaaggatactttgacattttcatagtattgttagaatcttttacaatgataatgtattcatgtattattatataattttaaaataccaggtgctcaacaaacctttgttaagctgaatgaatagtttcattgttttattctatctcttttattgctattttctgtctaaaattgggcttttcaaaacatttcaaagcagcagaaccattcagcaattaaatatgaacagttcccagatacataaaacagataaaacagaatttgactgaaagggattggctgtccaaaagatccaaataatatagtttgaaatctagtggcctacaaaattatcttcaaaatatctgaataaggaaaatttgggtgttgggaagaattccttttaggtatttaaatttattgaaatatctttatagtgctactgtcaggagacaggaccccttttcatgttattatgtatcttttggggttttgtgtccactctcttacaggtaatttttgaatacacctaacaataaatagggctttgataataaatatacaagttaaccttgaaattataagacttttaagacaaatgtaactttgctttcaaggaattcatcttgcaccttgaaatgcaaagatattcagctaggggtgttatatttatttgttgcaagaattttgggtttttattttctaaatccactaaataaacctatttagaaagtttgaaacctatcttacaaataaagtcctgaccattatggatcatgtcctgcttcgcagcatgccaagacaaaagcatataatattttctaagatactttgttttccctttttgtcagcattctccccctactagttcccttcatgttccttcaggctagggaatgctacagctgttgtactttacttccaaggcttgtcaaaactacagatctgcttgtatgttggacagttcccttcctgaaatatatacgaagtacattacccagatggtgacccctgatgacttcaggctttcaactaactcccgtgggaagcaatttcaccagaccgatacttcagtggccatgatgtgagactagatgcttctgcaataaggaatatcactgcaaaaataaatgctacttgaattaaatgcagtgactgccaacattacagaaaccaggttatcttcccatcttaaaataaatcccatttttattacattaaacatcaaattggcatatgagtgaactatagccctttgataaattaccttcagatctgaattttatcctgataataaccatattacatgcaggattgaaaactattagtttcagagaagcatttttcaagaactaaattaaagaagtaatgcatgtttatttatggtatctactattgcctcagcagtttcattcaacttttctctttttttcctagggctatacatatacattttatactaaaaatattatttgtgcttgcactacatcatgaacataaataaaacatacttaaatgtttctttttaaagcaatttaaatgtagtcagtatggttttgaggtctctttcaaacatttttgaaaacccgaaaagctgttgtgtcgtatataggtagaattccctttgaaagaaagaacttcgctaattaaaagaaaaaaaacaaaaggcattttaacttgaactgttttacaaaacacattttgcaagtctgccatgatgaaacattaaaattaaatgccaattaagaaaagattgagatagtataacagagcaatgaggacaccttttttgttgctccacgtgtttgaatccctacttttcctctcctaaatgaaatgaattattctctattgcagcatgcttttttcttttgccttagtatggtgctagttttatccaatactcaggatggaaaagatcctatcagagtaataaatcattttaatatcccagttctgtattatattatcttaaaactttcatttactacgtattttatattttccattccaagactacagcaatatttataaataacatgtctagttaggtaccttatcacaagtttaatatatgatctccatttgcagttgcataacgggcccatctgtgtattccttatcagacagacacaattatttagtggtttcatctcaagtcacagcaccattaagtgctctccataactcaaatcttatttatttttgtattattatttgctttgtggagtcaggaagaataagcagcataatgatgggataaatttaaaaaacagtttaatgaataacgtagcaaaaatataaatttagacatgaatcagtacttttaattcttctttaaaattttattttttttctattttacttcattttctgctcaactaattctccctttctctatggtccaaatcactgccaatcacttcttcattattgatgatgggagtttctcagattcctaaatattctcctactctctttcctggtttgagtacttattggcaatagtaaccaggttcttttaaaaagacccaaataaaacttgtgactatagagagtaagaaatagacatacacagctatctcttcctcttacccatttgacctgtatattatttaaatttttaaaatagaaatgtattcattgatttatatccacaacctctggtagctgatactttgaaactcacttttctgagttagcatcatgtaatcatagccataaatatgtggtatgtgtccttctgcaaacttttagatattggaattttaaaaaccctgtcattaacttattattcacagttaacgttaaggagcagggcttataaaaggctgggaagacaggatatgatagagaagatggaaaacgatgagtgatgaaaaactatgaaaccttctcatctgccttataagatgtgaacagatgaggaggtagagagagtgaagtggtgattataaggacccagtttgttctgggttttctgaagtgacaccatgacagtgttcttctgaaagagtcactaatgtattattcaaatggggttgattcatgatccggatcctcaagtcttctcctttaatgcagtaattatttgttggctggatcctatgtattagacattgtcctagttgctgaggatacaacacttactgtttggttgcaaaaagaactggccctgttggggatttcactctgtgtaaagggaggcagttgtcatatggtataataaagagcagggactctggagccaaggtttcttggttcaaatctcaactctgctgctaactagtgtgtgtaataatcttgggtaagttattctctgcctctcagtatcttcaccataaaatgtgcacaataacaacatctgcataaggttgttgtgaacactaaatgagtcagtatatgtaaagtacctagaaaaaaatgcctggcacatactaaatgcccaataaaggttagcaatcattattaagcctgtttaattgatccctttacaaaaccatcctggaagtggagaaaggtagaaagtcattgactcattgaattctctactttcctgccctaggagatgattgtgtagttgtgattctctgaagagagtaacacagagggcctccggtctttgagagaacttcagctgccatcttcacacagctgtagagttaaaacaaaaacctcacctaatttcctgattccaaatccttgacttaatatacaacagacattcatttatgttcccatccccatcaacatcccccaaagctgcaaatttctttaatttcctttcctctatcatcagggcactggggatctggaagttgtaggttttgggttttcttggtaaaaggattccagaaattagagcatccctaagattttaaaaggtatcatcatttcttagtagagtacactttttataaaggttagcataaagcagttagagtctcattttatgaataataactgataattctcacgtagctatatagtatgaaatgggtcccaagaaaactttcagctgagttacccagcacaagtatgcaatcctgggtgatggattctactctatcaaattgatctgcacaagtaagggaatctgtctgcaacaataaaatcatgctatgttagagctcaaaaagaccacagagtaatccagtatggtttagaaaggagggggccagtacatttaaagtgaagaagcctggaaaacactacctcagctgggttatcatcaatgatagcatgtacattatggcacagacacctgatatgatgcaatgataatggcacctctgtggtcttcctctccaaaagcatactgccagtttaaacataagcacaacatcagcaaaacccaaattgaaggacattaaaaaaacaacctggccagtgctactcaaaattgtcaatgtcatctaggtcagaaaactgttatagaccatgggaagataggaaaacatgacacgatataatatcctattttgaattggatcctggaaaagaataactggtgacatccaaatgaagtgtcaaatgcagttaagagtaattattgatgttcatttcctagttgtgacaaatgtaccatggtgatataggacgttgacaatagaagaaactatgacagcctttgtactatctaaaaaaatatatgagaaactaaatgaggagtatatggtaattctctgtactatctttgcaacttttctgtaagtctaaaagtgttctgcaattaaaaggatattttggaaagaacacaccacacacaagccatttgcctcaatctcctcattttacagaagaggaaaataacacctagagaaaggaaatgctttgcacctaggacacagagagctgacactaggaccctatttttctacctcagtcttgtttcacccaaccacactgattcagtcttacttaaggccaagagaatacgtaatccatttcttcttttcaatgacatttagtactgaagtaatttgactggaatatcggactaatgaggccaatgttataggttaagtttttattccaacccgttacttttgcatagggaaaaattccactatttgtcatagcctgattattcaagctattttttccatcaatctcaggtaagtacataagagagaaatgggaactctgtaaaaaccctccaattcaaaatacatgtacatctgcaaaatctttttataatgacacttaaattttattgaattactgggtcacatgtagctgaagtaaaatacactgtatatattttctactggttctacaatcttttctcttgtctacttcaatcttcttagcatttttgtcaaaatggatcactttgttgtcctaagctttgctcactatttttgaaaaagatgcaagtttctctttaaagaaaaggtaggcagtgggaagttaactcaatttcatatcacccctgaaaaggagtcaaaattttttcttaatgtttcctgaaatgctttaccatgatatcaatagatgtgggaaaataatatggcagtattttagtttcattatttttgtatggtttgaaactgtaattttggattttaaacaatgttaaaatatgcagtttatgttaaaatcttcaatatataaaatttcttataaatcaataaatatcagctgcacctttcaatagaaacatggacaaaagacatcaataggcaattcacaaaaaagaaatggaaattaacagagacaatttaaaatattcaaccatagtggtaattttaaaacgcaaattagaggagtgatgtcaacagtatggcagaataggcatttccagtgcttgctccctcatggaaacatcaacttgaacaatcattcaggctaaaaaattccttcacaagtgctaaggaattcaggtgagagattacagtatctggtggaacacagacataaaaaaagatgcattgaagagtgtaagaagaatagtttagcattacctgcaatactactctcccaggcttacacagcacagtgtggagagaaataccttccatgtggcagaagagagtgaagtaaacacctaacttcactgtagaacccagcaccatgcccaccccagggaaccctggtgccaggctggcacccaatgaccaagcttacaggcctaccctagtgataggcaaggcctcaaggcctgagactccaggctggtccacatagacccaagctccaggccaaccactaaacatggctggtccctgtggctccaggctttaggctagctccaatggactcaggctcccaccccagtatcaggctggttcccacggatctgacctttagtaaagccactgccaacccaagatccaaactcatcatagcacaaggatggcccttatagccctaagctgcattcattcttcatggcccaagggtttaggcctaccctagggccaggccatcttccatggccccaggtaccagtctggcactggtgaacccaagctccaggctcaaccatcattactgacccaggaaccggggtgccattactgacccatgcaccaggcttaccagcccaaggatttcagcaaagccaacccagagaccttccctgctggtccacacagaatccctggacaagctgacaggtgaagagcttctcctggtgaagccagtctttaatgactggagaaggtgccaatgccacaggaatcatgaataatcagggaaacatgacatcaccaaagggaaagcaaaaaacaaacaacaacaacaacaacaacaacaacaacaacaaagcacctgtaaccaaccctaaaaaaatggatagctataaaatgcctgaaaaataattcaaaataattaacttaaagaagctcagtgaactacaagttcagtgagctacaagagaacacagatagacaagtgaataaaatcagaaaacagcacgtaagaaatatgagaagctcagcaaagaaatagaagccataaaaaaaaatccagagctgaaaaacacaatgactgaactgaaaaattccatcaacagcttcaacaatagtcagtgaagcaaaagaaagaatcaacgagctcaaaggcaggtcatctgaaattactcagtaggaggaacgaaaggaaggacaaatgaaaaagagtgaagaaagcttatggtctcttcaagcaaatctgtttttttttttttttgagatggagttttgctcttgttgcccaggctggagtacaatggcatgatcttggcccaccacaacctctgcctcctgggttcaagcaattctcctgcctcagcctcctgagtagctaggattacagggatgtgccaccatgcccggctaattttgtatttttagtagagacagagtttctccatgttggtcaggctagtctcgaactcccaaccttaggtgatctgcccgccttggcctcccaaagtactgggattacaggcgtgagccaccgtgcctggcctcaagcaaacctgtatacacattatggaagtcccgaaagagaaaataatgagaaatgtgtggaaagattatttaaagaaataatgactgaaaacttcccaaatctgaagaaggaaatgaaaatccagatgcaagaagcccaaagaatccaaaatagaaatagattgaacataaagagatatatactgagatattataatgaaattcacacaagttaacaacaaaagagaattttgaaaacagcaagagaaaagtggcctatcatatacagagaaccttcaaaggaatataagtggatttctcggcagaaactctgcaggctaggagagagaggggtgatatagccaaagtattaaaaaagaaaaccctaccaactgagaatattataactggcaaagctgttcttcagaaattcaggagaaataaaggcctttccagacaaacaaaagctaagggaattcatcaccattagatctgctattcaagaaatgctaaagggtgtttttcaacctgaaaataaaggatgctaactaacaactaaaataaatattagaacatacaaaagcataaaattcagagcttgattcagccattcgacaatatatacatattttaaaacaatatattgcttatccctgatgaacattgatgcaaaaatcctcaataaaatattggcaaaccaaatccagcagcacatcaaaaagcttatccatcacgatcaagtcagtttcatccctgtgatgcaaggctggttcaatatatgcaaatcaataaatgtaatccatcacataaacagaaccaatgacaaaaaccatgtgattatctcaatagatgcagaaaaggccttcaataaaattcaacatcccttcatgttaaaaactctcaataaactaggtattgatggaatatacctcaaaatagtaaaagctatttatgacaaatccacagccaataacatactaaatgggcaaaagctggaagcattccctttgaaaaccgacacaagacaaggatgccctctctcaccactcctattcaacacagtattggaagttctggcagggcaagcaggcaagagaaagaaataaaggatatttaaataggaagagaggaagtcaaatagtctctgtttgtggacatgatcctatatttagaaaacctcatcgtctcagccccaaaactccttaagctgataagcaacttcagcaaagtctcaggatacaaaatcaatgtgcaaaaatcacaagcattccatatgaaaccaaaaaagagcccatatagccacgacaatcctaagcaaaaagaacaacgctggaggcatcatgctacctgacttcaaactatactacaagaaaccagcatggtatcaaaacagacatatagaccaatggaacagaatggagacctcagaaataagaccacatatctacaaccatctgatcttcgacaaatctcacaaaaacaagcaatggggaaaggattccctatttaatgaatagtgctgggaaaactggctagccatatgtggaaaactgaaactggaccccttccttatgctttaaaactttaactcaagatggattgaagacttaaaagtaaaaccccaaaccataaaaaccctaaaagaaaatttaggcaataccattcaggacataggcatggacaaagattttatgatgaaatcgccaaaagcaattgcaacaaaagctaaaattgacaaatgggatctaattaaactatagatcttctgcacagcacaagaaactatcatcagagtgaacaggcaacttacagaatgggagaaaatttttgcaatctacccatctgacaaaggtctaatatccagaatttacaaggaacttaaacaaatttaaagaaaaaaacaaccccaccaaaaagtgggcaaaggacatgaacaaacacttcttaaaagagacaaagcaagacacagaaagacaaatactacatgatctagcacacatgtggaatctaaaaatgtcagactcatagaagcagagagcagcgtggtggctgtcaaggactgggggtagagaaagtagggagctgatgctcaaagggtccaaagtttcagttacacaggattagtaaattctcgaaatctaatgtatagcatgctggctatagttaataataatgtatacttcaagattcctctccactcctctcctctcctctcttctcttctcatagcatgctggctatagttaataataatgtatacttcaagattcctctccactcctctcctctcctctcctctcttctcttctcatagcatgctggctatagttaataataatgtatacttcaagattcctctcctctcctctcctctcccttctcttctcttttctcccttcccttcctttcccttcctttcccttcccttttttttcttttcttttctttcttttgtccaggctgacatgcctgggatgtaggctcactgcaacctccacctcccaggttcaagcgattcttctgtcttagcctcccaagtagctgggattacaggagttttcttttattttatttttcttttatttttttttaaaaataagtacaatttccactttatttttctccagagagtagttttccttcagtctgtaaggactcagctccttacaggggccttggttggggccatggggaagaacccacaggtctaaatagtggtaggggtgtttagtccttgcaggcttcacgagatcaattcctgactaccttgctgtgaatggtacaattcgcacagcaatatagcttcacatacagcttgggaaacactgtgagcattgagggctcacttcagaaatgtccctcactgctgtggcctctgctatgtttttaatgacaaacttcttaatagccttattcctgggcatgcattgagcacagttcttgcagtgaacaggctgcaagtgaatggcatgaccattgttccttctttcctttggcattttggaagcaaggatcctacttgaacatttctaagagagtggatcttaaatgctctcatcaccgaacaataaaaggcaactatgagggtgttagacatatgaattaatttgattatagtaatcgtttcatagtgtatactgtatgaaaacatcacattgcgtaccttaaatatacacaatttttgtcatttacacctcaatatacctcaataaatatggaaggaaaatgcaaactaagacactgaaatacccttttgcctatcaaaatggcttcttttcttttttataaatgatgatgtcaaaagttttccagagttcagaggaacgaacaccctcacatactgctggtagtgtaaagtgttgcaaaaatgtttggacaaattggcaatatatatccaaagtgttggattttttaaaaaatatttttatcaagccatttaatgtttagaaatttatggtaagaaaaaggtctgaatagatttaaaacattggtattcagcgtattgtatataatagcaagattttgaaaattactcaaatgtccaacaaatgggatcagttagacaaatgactatatacaatagaagatcgtgttgccattaagaatattacagaaaatatttcatgatagagaaaaatgtttacaaagcaagtgcaataaagcagtatataatatgagctccattttagaggctgtttagtgtaataagtgagggcacaggctctttttgtgtcagacagattcgaagagtaatggctcttctatttattagctatgtgatgttgtacaagctcctaagctctctgagtctcagttttcctatatgtaaagtagaaataatacaataagccctccttatcagtgaggaatatgttccaagacccctaatggatggatgaaaccacggatagtaccaagctctacatatactatgttttttttttcctacgtgtacatgcctaggataatgtttaatttataaattaaaaagatgaacaataataacaaaatagaacaagtataacaacataccatgataaaagctatgtgaatgtggtgtctctctcaaaatatcttattgtatgtaatattttcagaccatagttgaccatgggtaactgaaattgtaggaagcaaaactgtggataaggcagtactattgtaatacctaatttggatgagactatgattatgcataaagggacctacatgagttaaagtagaacacatgcctatttctagaaattaaatgattaatttttccatattacaaatattaaattctttttgttgttgttcagtgtataatcaattaccaccattcttctttctgacactcaaatttggccaaggggaatcccttcaagttggctcctgtgtcattttggcatgcctgaacacttccttgctttctagcacaagatatcccaggcttaccttatacttactttccctgccacagacctagaaacagccaatccttcaaggagattttggtaggaaatgtatttagaaatcaaagtttgggtataaggtgtattaattactactgaggtgttattgcttttaagtcctttcagaggacagactaggaatatacaaacaaataaaaaaatttttagattttataacctgctttgttagagtgtgtgtgtgtgtgtgtgtgtgtgtgtgtgtgtgtgtgtgtatacacacatatatgtggattgctacagtttggatgtttgaccctccaaatctcaggttgaaattggattccaaatgttgaaggtggggcctaatggaaagtgtttgagtcatgtgagtggattcctcataaatggtttcgtgctatcctggcagtaataagtgagttatcttcttgttctactagttcttgcaagtgctggttgttaaaaagagcctggcacctccctcttctctctcttgccttgtgatctctgcacacactggctccccttctccttccacgatgagtggaagggctttgaggccctcaccggatgcagatcctgtgctatgcttcttgtaaagcctgcagaaccatgagccaaataaacctcttttctttataaattacctagcctcaggcattcctttatagcaacacagactaagacatgcatatatgcagtttaaaagcacaagctcatatatatatatatatccccaattctaatccaacacttcagagttcttctttctcattccatatttttatttccttttccacacaatgaaccttgttcccagtaacatcaatatatttacctgtttgcttatcctataagatgcacaaaacagtattggaattattatagcaaaaccattactagaaatgagcctactaagtaaagttcaaattttgtgtttttgtccttagaatatattcccctgagggtatacagttagagttatgtattcaaaataatgactcttcttaaactcttaaaatttgagacaaagaaaagaaaaagaaaatggaaaaaaaggcaagagatatgagcacacaggtaacaaaaaagatccttaaaaatatgaaaagatagtcaaccttactttttcttaagagaaaaacaaaagaaaactacactaagacgtcatttctaacctgtcaaactgacgattcaaaagcttgcagcacagtttgatggcaatgtccgtggagacgtaaacacgttcatacattgctggtgggtgtacgaaatggctcaatcattatcaaaaagattcatgaaaagttgccacttacagttttttacaactttcctctgtttcaatggttatttctcctcatttcttacttcgtatatatttccccttttctcttgatttcagattatttatggtctgcctacttgttaatttttaacactattttatttatctttctattatttttgtttcctactccattaatttctgctatatctttcttatttcctttcttgtgttttctttttattgatttttcagatttgttttcttttattgatgtgaattttcatcttatacaaggtttaatagtaatttaacatgtggtgtgttcgttataatttttcttagatattttaaaattttatgttttatttccccttatacacaagaattgtttaaaatttaaaaaaattacagatagaagggcttttctggtatttaaatattcttattaatttgtacgttcatttcaccatgatctggtaatgatgtttgtattgtttctaacttatgaaactcactgagttgttacctaatatttgctcaaattttgtgaatgttttatgaaaccttgagaagaaggtgtattctctaatatcagggtgtttaagttcaatacatagccatgggatctatcttgactaaatattctcccttataagtgggagctaaacattgagtacacatgttcacaaagaagggagaaagagacaccgggaccaacttgagggtggagagtggaggaagatgaggatcgaaaaactacctatcaggtactatgcttattacctgggtgacaaaataatctgtatatcaaactcccttgacacaaaatttacttatagaacaaacctgcacatgtacccctgaaactaaaagttaaaatattattaataattactattataatacattaaaaaggatctatcttactgattttgctttcttaggtcttcttctatatatttactatgtttttgtccacctgacatgtcttgaactgaaagtggtgggtcaaaatttcctaatctagtagggcttatgagtacagtattctctgagttcttgcatgtttaaagtatttttctagatccttaataattaaagaataactggtttgaataaaatccttggctcatactctttcttgagttatttgaaaattctggccgggcacggtggctcatgcttgtaatcccagcactttgggagtctgaggtggacggatcacctgaggtcgggagttcgagaccagccttaccaacatggagaagccccgtctccactaaaaatacaaaaaattagctgggcgtggtgatgcatgcctgtaattccagttactcgggaggctgaggcaggagaatcacttgaacttgggaggtggaggttgcagtgagccaagatcatgccattgcactccagcctgggcgacaagagtgaaactccatctcaaaaaaaaaaaaaaaagaaaaaaaaaaagaaagaaagaaaatgctgctctactcttaccttgctttgtctgttgtcaagatgtctaatttcaatctgattttctttcttttacaaatgactcctcccactaaaaggcccagagatgattataaataataattgaagtttaatatttttagtagcacatgactaggagttgatagttttgagtcagtttttgaaggtacttggaggtaattccaaggtattaaaggttgtgcccttcaatacttacagtcaggcctattatttctggaaaattttctttgattatagttttaaatattagttttatttcattgttttgtttttcttctttgggaaccattaatataattatatgtagtttgtatttatttgactatcttctacagcaattattttctctgatcttttcttaaacttctttctttatttcaatttcgttccctttgctattcaagtgcctttcatcattgcatctttttcattttaatatcttttctcccttcgtcatcagtcagtatagtattcattttcacgatgggtttatctttttcttcaatttattccctgagtttagtcaactctcattttgtacatttctgttctgagttttaaactttatcatttgagcctttttcatatcttcaaatgtttgtttaaggcttattaggactgagatgttttattgctgtttttttctgctttggggttggctattagaagttttttttttaatcaaatgaaatgattaattcttattttctagttccttcttatagagctttgtgtaggtgttgtctcccttttatgttcattctgaaatattttagtttcctggaccagtaataggagttgtatgtaaataggaatcaggagtttggtgacttgttagattactagaattattagttcttattaaagtgtagcttttaaaatcaataatggcttttggatagggggtttggtaggtcgcttaattttgtgattcacttttatttttgctgtatcctgaaattatacctcttgctttcttctttctcttcaccaccaagcctccaaaggacatctcttccaagttaatgcccccatgccctcagaggttgtgccttcccaaggctaccaactttacttctgtgaactttaaagtacattcctttccattttcagtagccattgctctcatatgccaggtctgagattgttcaaacagttttttaatgggagtaattcttctttttaatgggagtaatttgatcaagtctgccatagctgggccctagctctcatgtcttcttttccatttagcctctatctgactctcagtcctggcatgggctacagagacaactctgagtaatttgggtgcttatttctctacctatgtgtaatctgaagtttgtagaattatctatctcctatttatgttattgagtgggttacaggtggttttacttgcttcccttctgcatttgaatttctttttgaataagggaatggagagatttggatttaaaaggccaatgttaccctatgggaacccagaactcactgttaatatttatttttacgtttatataatacatatgcagacacacatacctgaacattgtgtacccagtatctataacacattcatttgaaacaagtctctaataatgggtatgaaatataattttactgcatgctgttctttacgttcagttccatgcatctatgagagagtcatccatggttagggccatgatttgtaactgtggataaatccaggtgtactaacagggtgactgtgttgtattcttaggcatgttttcctgcccttcacataatttctccacctggatttttaaggcttggaaattcatagtgagtatctcacttctttggcttaaagtagtgatggcaaatatatttcaacttctgagttgactctaattgcagaacctagacttttttagaattaacactttgtctcctgataaagtgcaaattacgtaacggagatataatacacttatctttgttatagccatttatacctcagtgtgagttattttattatgtggcttcaggcttagatatctacatagaaggaaggcagataatataaaagagtgaagagggtaggatgggtattcgatggactggagcgttcatggtcctatttagccccagttgatggttctcatactatttttgccacaacaaagactgaaataatacttgacacatagtaggtactcaataaatgcatggggaaatgggagaatgccgggccagggatgacagatctatttttaaagagaaacaagacattttatgtaaaacctcttgacctaagattcaattctgaattcaggttttgttaggaagtagaagacaggactaagttcctgatttggggagggaaacgcaaagggagattgagactatgggctttggtaatgaaacagaacagaactgaactgacagattgaaatagtaactgagcccatgacctcagcctcattagcgagaatgctactgaggcagtcagtgagtaatccaaatatttttatttctttcctacctactcaaatcacaaaagacatatgcactgtaattgcctataaaaaagaactatattctttaatttgctatgcatgctaacaatgaattatgcttcttttaggccaaaatatgtccctaccactggactccacagtcttcattttttgaaagtctatttaactgtgattgcccattgaacctcttatttttaaaattgagggattttttttttccttccagttaatgggttatacatttaatagttcattgattcaaaagactagattgttgcctatcagcaaaaagatttatatgatggctaacccaagttatataatggcagaatttgttcagagaaaccaaactaaaaacatacagaggcaggaaaagaaaccaaagatactaatggtttgtttgggttttgtacaatcttagaacaggctgtgttttaggcatgacaaagaaaggatctatttgtaccatctggctttcaatactcccacagtctcctatgttggtaaatcttaagtagtgctatctctacaacattctatgagataatattggagcatgtgctattatagcctggagtagcattgaatatttccagtcctttacattttcccactggtataagaactttcacctctaaagagccaaatagttcaagtaggttcaaaagtcatctgattcttcaactacttatcgactgattgaggctagatttaccactacaatcagacatttaaaaagaaaaacttcttgactctctgctaggtggtacaaaaaccagtgaactatttgttagcttcagaggattagggttcaataggtttctatgtctggaggtagcacatgatctttaacaaaaccactccatttcaaaaatttccactttctttcatagtgcaatatacttgttcctagtttcttgacagctggtatctctctctctctctcctctctctcttaagcattgtacaactagtattggcttagctgcttgttatgagtaaaatccaaaatcttttatctgctctctttatttaatattattttcatttaactccataattttattagttaattctgcaaagtatttgtggatatgatatatataaaagactgcattattgttatttgccatatttaatatctacgcttaattaaaattaaagttcaaaaccaaaggaaatgtagattcataagtgaacaaagggtaaaactgaattaagaacgttgaataatgggctatttgatttaatgaaacctatgactaccaaagagcaaagtctttgtctgtgtagcacagaatggttgcagtcaaaaatcacatttccattcatttttgaccagagctgcagctagtttatctgagagctcaaccacctcctctggtattctatgtatatatgctagcctacagttccctgatcatttgatcaggaaagctcctttaatatgagctaaatgaaatagaagcaagagtgcttttcaaagtgccagatcatatatcttttcttcctgttaagaatttcccattgtcacatccaacccaataatcaaacatttgtgaggcccttccttagaaactcttgactaagcaattaccctggaagttaactataacacagtacacaaggtctatgttaattagactggcaacgctttgatgaggctttgacgagtagaaaattacagtgagccatcttggatcctcttaatttgttcattactgtcccatagagaggagtaggagccccaaggaaggtgttcctgagaagttacactgtaatctgaaattccacgtgggtcttgcctgtatggaggatgcaatacaaactagtgctattatttaaatgctatctgtactttggtgtaatttgttaatgggcttgtaagtctacccaggaaagactactttgtgggatcatacctagacaagaatctagccttccatgaacaaatgacttagtcttagtacttctttattgcccttaaaaattactgaagatgccaaagagcttttggtgacatgagttatatctacattagaaattaaaatggataatttttaagtatttattaatttattgaataatatatagataccattacattttaacataaatgacacattttgtaataaataattatatagtattttgcaaaacccaaaaaattagtgagaatagtggcattgttttacatttttgaagttctctttcatgtttggcttaacgaaaaacaggcggactctcatagctacttttgcatgtaaattcttgtgatttcacatgtcatgtggtctctgaaaaactacactgtacactcctgagagaattacagtaaaagagataaataacacttttatggtattatgaaaatagttttactttatagatgctttgacaggtcttggaattcctagtggttgctagacctcacattgagaaccactattttatcttcaccatagaatgttttcttccaatctttctagttgtttcttcatagtctgcttagcagattccttttccctgggcttcttgaacaccagtatttcccagagttcaagtcttcatactcctttttccttcctactcctacgattttggtgtcctcaacggtagttacctccaaagtttcagcaccaaatatttaataatgttctaggtatctctacctgtaggtccattttcacccttaagcctcttccttccatttgctatctatcttgactaatagcatcaccatctacccagtccctaagccagataacaacattctctcctgatacatcttattagtcactaagtcaagtgagttttatcatttaaatatttctccattccatctcctccttctccattaccagaagtttatgctctcactatcactaatctgtattactaatatagtcttctaatttatctccatgttttcaattttacaaacccatcgtcctgcctgccaaacccaacttcaatactgccattagggtgatttttctaaatgtaagtctgagcaaataattgtcttgccctaatgaaaaaccacaacaactctccatttgttctgggaataaatttcaaggtccttaccatggcttaaaatgccttccataatcagctcctgcttaccgtcttcatttcctgccacctttctgtatctttccttttttgcttccccaggtattgcaatatatttgtatttattaaaacatactatgcttttcaacctttctgtgaagcaaatattgctgaaccctaaatggataagcctccaccctgtaagatgccacctgttagtgttgactatgataaatcagatattttgttggtgatactggccctccccactctggctgttctagataaaaatttagtcatatttctgaagtttaaaatgggttaacctgccatctgtttaaaagccattgctctaatttagtttattcttattcacttcagagtaagtatagcttaacgacttatgcaatgtggctctaaaatattcacatatctatgtatgcactatatatacaatttgggtggagagaaactgagttaaacaggagctaaatttcttctttatgaaatagaattcaagttatttactgtgaagtcatagatttcttgagagattttttttttggtctgagtttgcatgattgattcttactgttctaaaatgtcttaagcatgcaaaactccaaaatgactaacctcctgtccagtccccctttattatgcctaccagtagatctttatctatttcacagagtctcattttaattttcctagccgggctaagaaagtactgtatgagaagtacttagtagagtgattgcctctccttgagacaataatctcttgatgcaagacatatatttagtatctactacttgttcacccaataaattatttctcttactctgtgtcttaaatacattctggagttctaagaaaaaaaaataagtgcagtatttgcctttcaccaagatgcccttagtctgaacaacaggacctaactctgattctagaaattagttttatttgacatggattcatcatgtcattttagtatgtttaatttggattggatttatacttttatttatgacaggcaagagtgccacttaacatggtggggataaaacttatggaatatattataccaaaaggtgatgtaagaagagtctataaatcttttttaaagaaaggttctggtaaatgcatggatagcagatttgtaattagactgaagtcataccaccattttccagatccctgcttagagacattgctagaaggttggtagattcatgaataggaggaaaagtcaatgctaatataaaaactgtcagtattatcatgattgggtctataagagtgaattggaagaagtaataagtattaagcatgacagcaaaaggattgataacggtctataggataatgtgaaatgctttttagcattttatgctgagtcatttcttgaatgttataagctgtaatgcattttaatgaaaacgtgtttcaacctagatatggccttcagataaaaatacaaaaccatttgaagggtcaaaacatcatagaagagggatattagtaaaataaaggcaaagtgacagctatttcagaccaggcagaaggaaacaacaaactcattagaggattcttgtgagacagacattcatgctctgaaaaattgttttagatgactttggaaagaagggaaacaaaagcagttcatgttaggatgaattatatcctcattacccttaccccagctcaaactaaataatcttcataataattctatttcactaataattatcattaatctttattcagctgtgctaagcaatgtcctgagtgttttacaagcttcaactcatttaattataaagacaatccttgaagaaagtattatcaacattcccattttatagatgaggaaacgtaggcacagaaagattaatgaagttgctagcactataagtgaaagagttgggctttggtaagcatatttatctacatttagcaaatactgtgtgagggagcatttttatatttagatttaatggggaaaaaactccatttctatcctctctgttaaaaaaaatctaaattcttgaattttccaaagtcagcacatgccacagtccactttatgtcttccctgtatagtgaggtatttgcactttctttttgaggcggacaaaatgaacacacaccactcctttcattctattattttcagcactcttttactccactgtagtaaacccccaaaatagggcaatttgggccagtgcaaagaggcaaaaaaagcacttgaatctatgttattgaattttgctgcagagagcaacatgaagaaggccctttgccctcttgaatagtttcatctctaacctttggatcagagaactgggtacaaaactctatctcttctagttctatattgttaatatccattgtggtcagctttctacatgtaggctatatagtatgtcatgacaagatttatggactgaaattatttcatctgcacagttggaatactacctgtatcccctgaaggtggtatggattgctactaatctcatggcaaaggaaaaggatcatccatgtcattaactaatgataatgggtacgagagccagaaacccctactcttcagctcattcaatgtaacagcgcacttgaccccaggcacaatgtattcatgtgagtttccatgtatgtgagattctgtagcctcttatacaatctgctgactgtgaagaaacttgatcaaaacatcaaagattgccagagaagctgtgtttgtgcccttcacaaccactgatgaagtaccttaacctcgccttctcttgacaccttgcatatggtcatctgtcttcctgactactacttcatatggcttatttgtaaattcaagcaaatgtgcttctgactggcactgatacatcactgatgccaaaatatcagaaaagatgaagcataaggacatactttttgattcagatggaaaatattacagatttacgaggaagtgatgacaatagccattccatgctatcttcatataatcagtatttttccatgcctctcttcaccaacttttttgaactcaaaacttattcaaaggaatgatttttttccctgatccaaaaggtatagtgggtaggtgtggagataggactggttggctgaacaacccagctctggcttttcacgtgctggatttccactgctttccaatgaccacttacagagctataatgcacagaatgactattgatgtcccattgatatcgatgcgatttcccctagtggattgagggcagcacagcatacagccattagtatctaaaggttatgtataatggataatagaggaaaatgaaatagcagaaaggaatttgcatgggaaacagaagcagcaagtagtttcagtgaaagattttacttgggttatacagcaactgcaaatggggattgaaaaaaatgatgacttacagactcagcaatagtcgagaatgaaatggtttcatattttgaaatataatacttttttatttcaaccacagaaagccatttaaaaatcatcttgtatattacagctcttatgtgctatctttcacctgaatgcctatttatgaatttttactctatccttctgaggtggtcaccaatatggcacagatgggataaatcaagagagatttttactgacttatccagtcacataatgtccagttcatgacagaaccaggaacaaagttccagtgtttgccataaacatcttctcatattgaacccactcaagttactgtgccagcatttagcctgatatttctgcatctaaaaaatctcccagtaaatgatttcaacaaatattgcttaccaatcaaccaatcttagtggcactcaccatgggaatagatgacttggtatatctaattgaatttgtaatttaataagaaaaaatatctggtggatttattcagtagactgagaagtaaacaagttataaagtttacttcagtgctagaagagcagcaaggcctagcactcaagagtcagtctgctctggcttgaagctcagcatccttatttcttagcaaggcaccctcttaatctcaaaagtggcctctatgtgacctcttaactttgttgagcctcagtttccccatttataaaatacatatgtattgatacctatccttaaggattgttgtgagaattaaatgtgctcatacaaggaaagagcttagcataattcatttttttccaacaaacttttactgaaagggcttacacgtgccaggcactgttcttggtgctgagatacagccatgaacaaaattgttaattctgggaactagtgaattttaatcgtgaataataattatgatggtaacaatggtaatattaatgataatatttaacatttataggctacttactatatttcaggcactactccatgtgctttacttatattaactcatttaattcttctaacaatcctatgctataggtacgattttaagcctgttttacagatgaggaaatggagacctgaaaaggttaagtaactcacccaaggaaacacacctaataagtggcagaggtctgaaaaatctatgttaataactattgaactatactgtcttacttccatgccaaattgatatgccattgtttattctattaaaaaagacagtccttgaaataactgaaatgttccacttttgctgatgaaatgaataaacatacaactgaattaaacaagtttcagaatatgtaataaaattttgatatgggagtggccataataataaatttaaatagaaaattagtattaaacatggtataaacctaaataaagagcttgctattacttgagcttgtttacaccaagggttaggccttgtatctaaaacattatctctctatatagtaaaagttaatagaaaataacccatataaaagtttatctcaattgagcaagaccattttaaagggactctaatgtatttaaactttttatattattccttgttctcaatgatatatgaaaatcatgtttgagttgtagaactttctcatccttcgcctccattccttcagcagtatttctcattacaggtcaccacaaaccaaataaacacacatgttgggttatcctgaaatgtctgagataaaagacacagttttgatattatagggtaatataatccatgttaaatagaagcattgttcaaatatattcagcttgtgtgatgaaaatataaaagagagaatcatgaacatcagcgcaggctatgatcctatactgtttacatcatcagtgacctccctacaaaatatagccgtttatttacttaccatccactggtctatgatgcccacacaaactcattatgtgaacttttagattattctcattttagataaatgggaatcaaccaaatgtactttattacttaaagaaagtctaagtctctttttatctgccactcaaaatcatattcattgtctcttagtgggtaaatctgcttcaaataggtaactggggtaaacctgaaaataatttattagggatatacttggatagactttgttttctacaatgacattctattccttctaggaatagtgctgccacaaaatacacacatttcttaagtcagtttacattttagactgcagaaccactcaagaaagtaaattaatattcagtcacaataaaatgacatccagaaaaatcaatacaatttgctaccaaatgagggtgactttaatcagggtgactcaagaacaacaacatttttcctaaaagtggaaagagcaccttataactgctctctgctttacttttcaagacatagtaactaaacaattttgcagtcatttacctagtgaaataagaatacattttttggtcacagtgtaaaaatctgaattcttgggaagaaattatgtactgaattttctgatagcttccaaataactggggctttaatgaaattgctacctgaaaattccgtagcagtattattgtttaactgtaatttaagaagctattgtagattggtacttatgacttctaatgggaaaaccataacaaccttttaattgaagggaaaatggttaactacagtaattgcgatcaataagactgtgttagtagtataaatatttcttctcaaagagcattccttactctcctcagcagtatttaaggttaggaagaaaaaaaaaaaagaagaaaatcaatttgttatcatactaagcctaggtccaaatgtgtacatgccagaatcgagagaaaaaccccccattcccaccacaagcaaaacaagactttgattaagaacaaaactgaggcatgacaaaaaggacttaccaatcacataggctagtaacaaggccaaagtcactgtgattgcagtggcgctcaatgctgtgcacttccagttgcagcacctgtaaggtttgttaaaggtaaaggcaggtcgggaaaaggtgcttcgaggaagaggcctgggagggggcgagtacacggtattggatgtcagagggtagttctgactggctgcactgaagatcgcagaggaaccagatccatgtttgaacaggaaatgcctgtgaaaaggaaacacaagtttgggctataaaaagcaaagccagttgctacaaaaacacaaactccattaatttcaaacaatcatgctatagccaagctcaagagaactggatggagctcagcaacattttcatatacctaagagataattctaaattgcccttgttgttctctctcttttctttgtctttttttttcttttttcatctagacctttaagaaacaggccttgtgttccccgatttgctggctagtgagtgctaacattccacatttggtgttacacactacacccttccctttcattaaatatgatcatcaagagttgattcaaaaacagagatgcatcattaggcattttgatcattagaatggcctagacaccagtgtttgagattatcctcactaccaaactttagagactagcttcacagccatattttcattcaacattttattataaaaattatcaaatatacagccaagttgaaagaattttataataaacaatcacatactcactaactagattccacagttagcatttgactgaactcactttgtcacatacttattcatttctccattcttctctccatctgtcagtttttagttttttgttttgttttgtttctgtttctgtttgtttgtttgtttgtttggttttgttctgagatggaatctcgctctgtcaccaggatggagtgcaatggcatgatctcggctcactgcaacctccatctcccgggttcaagcaattcttctacctcagcctcctgagtagctgggactacagttcgcaccaccacgcccagctactttttgtatttttagtagagatggggtttcaccatgtcggccaggatggtatccatctcttgacctagtggtccgcccgcctagcctcccaaagtgctgggattacaggcgtgagccgctgtgcccggccagtttttagtttttaagcattttgaagtatgttgcatacatcagtacacttcccttcatatattttaactcacatattattagctagtttgatagttttacaaattttaatgtaaaatttatgcataataaaatgtgcagttttatgtgcacatttgctgtagatttgacaaatgctgtcacctatgcaacccaaacccctatcaagatgtataacattcccatcaagacaagaagttctcttctgtcttttctaggtaaatccctatttctattcccagagaaaaccactattctgcatgtttttgccaccatacatttgttttgcctcttgtagaacttcatgcaaatggagtcatgctactgtcatgtttgaattactaaagaatgattgttgagtgttcatgactattgtaatatgggcattttgtaaacagtagtaatgtattcacatggaaggagttgccaaaaacaaataaataaataaataaaattgcatatacttcttttatacaacaaataaataaaagtacttttatacttgctaagtgccaagtgttgtgctgaacactcattagtatctcttttgctctttactcttatgaaatagtctatattattctcattgtgtatttatagaaatggagaccaaaagaggttaaacaacttgcccaaactcacctagcaagtgaaggacagagccagaatcagaatctaggtcatttggggttccaaagtccttaatctttttttttttttttttttttgagacggagtctcgctgtcacccaggctgtagtacagtggcacgatctcattcactgcactccagcctgtaacttccagatctcactgcactccagcctgtaactccagctcactgtaacttccacctcctgggttcaagcaattctcctgcctcagcctcgcaagtagctgagaccacaggctgccgccctgcctggctaattttttgtattttagtagagacggggtttcaccatgttgcccaggctggtcttgaactcctgagctcaggcaatccgcctacctcagcctcctaaagtgctaggattacaggcatgagccactgtgcctggccaatcattttttataaacttttttcttttcttttttatctttaattgacatatataacaattgtgcatatttatggggtacatatgagacaggaataatatagtgtggttgcaggagaataaaaaaattccaggcagcagtttcacatgattagaggctatgggctattaagaccctgaataataggatttgaaccaagctggctaagactgactggacccaacgtggtgcgggatttgacctaggtttcacctcggacttcattatatcctcattaacatactaaatcacgcaacccaccagcaccatgacagttccagaaatacccatgtttggtgtaaaaatgggtggcaccacagttccgataaatctccacctttttacaggaattttcatgaatattctaccccttgaataaacaaaccccaaaaggtagcagctccaaacccccttgtgggtgattctctcttgagtacacttatactcccttttcttgagtgtgtacatttccctttgcaataaatgtccatacttccactattttccaacttgtctttgagttcattcttgcaacagtgtcaagagcctggacaccagctgtggccaagatcccgccagcatttggggacttcccccagcctaccagcatcacatagtgttgtttcaatacatatacatgtagaatgagcagatcaggataattagcatattcatcaccttgaccaaagtctttaatcttaagcagtctaccgtattacctggggcagtaaaataacaaaacacattcgagtgctacattttaatgtacaacaaaaaatttcactaagcataaagccaacatcaccttgtacatgtaatgtgtgcacaaatgcataaattactaacattattttaagactgacttctagcttccatatttaaagaacaaaagcatatgtatttaaagggattaaaaaaaccctatatgaatgttaatggaaaatacccacaacagagaattttgcttcagtatcatgaggttaaaaattttttaaaggactgggttgctgaggggagtacagattcacaggtctttctggagggcaatttggcattatgtatcaaatgactttaaaaatgcctattctttgatgcaataattatggctataggaatttttcctcaggaaatgatgtgtatgacaatccatataagaagccattcattgcaatgttatttataatagcaaaaaataaacatctaaatgcccagtaattgctatttcattaagtaaattattttataaacacataatgtagtactacacaatcattacaaattgcgtggcaaatgactgtctattcactgggaaaagtgtttacagatattaccaagcaaaaaaaggcaggcttcaaaagagtatgggcaacgttattcaatttttaaaggaaaaaaagtacatatgttcaaggaaaataataatttatgttacctttgtatggtaggggtattttctgaacttttctgccttgagcttgtattgattttgtaactaagataaaaaaaaagattcatgagtattagggagtggaaaacatttacaggataacaccaaccacaggaatagttggttccatttaagttaacgtgatttattgagcgcctagatgggccaggctccaagttaggcactttgtctccaattttgatccttatatgtctgtgaagttgatactattatcctaatcttctagatgactgaactgagacccaaagaggtttagtaggagtagagcggtgataatagtaattattataataatgttagtaagagataacatttgagtgattatttttgacaggcattgctctaaatacttcacaaagtattatattatttaatcttcataacaactttattacagtcgatatctctattttacagatgagacgatctaagcacagagaggttaagtcacttttccttggccccacagctagtaattgattaaactgagtttcaaacccaggcagtctggctgcagagccactgctcttaaacaatatactataacatagtgtattgtttgtgatgggaatacaggcctgttgaggcatagaataagtatgctttgtgttgaatttggcatgaggatgatgtttaactgagccacactattacattccttttctgactaataacaagaatgtgagaatgatggctacagaatcacagagttggaagggacccgcagaaatcatctagtagcccatccctctcattttgacgttagggaaactgaggccaagagaatgaaactttcttacttaaaaataacatagctagctaataggcatggatgaaactgaaatctggggcttccaaaatagtgtatttacattaccccatgctacttgacaaccacagtcttcaccagattagcatcaggttctaatcatctgggttaactgacctgggcccaacaaatactatctgttcaaacagtactacataatacacatctattcttctgtatgtcaaatgttcttctagtaaattttaaagactgtcttaactattttggatgaatgggtaagcattacaaagaaactaccctttagttgatgaaaacctaaaagagttactactgcttctaaaggcacctaatttatccccagaatgaagaaacaatataaaaataataataagattaagtatattttaatgaataagtgactcttagttgtcctcttttcatttgattgtgctgttactttaaggcttttaaataaataacctcctccgcaccataaaaagatgaatttcttttttaatgtctgcttaactctcccagactgtttttttcccctttgaccatttcatttactagtgagcaagaagtgtagcactatacaggcagcgtagggatgtagcctccctacctccccactcctgccctgtggttactttggaggtgacaaaatgtcacatattatggattcgatgcagcaacactctgatatggtcctatgggacaaaggagaaacccagcagaatgaggttcctttacttaatgtttggagataaaatcttcaatcttttgcacatttatgaaggagaataattggatttttgagacaatgtaagtgttccaatatgttggatattgatttggtttggtataatattaagaggtggaaggaaggaaaacaaaagacagagaattgttggctattatgacggcaattacaagaataatcaatatccctgagccctgtaatttcatcctgatgtacaccaaaggatttccaaatgcagtttcataagtaaaatattacagcataatgaataaattcaacagttgcagcagaacaacatttaaactaatttttatttgagtggaatccaaatcacggttctcaatgagggtagataataaaatgagttcatgtactaaggttcttgttttcttattaacaaactcagattaagattctatgctgaaagtgatctgtactttgttgtgaaccatgaaaaagagcaatgcaaatgacgtgttttgtcataggctttgcagtccattgttggaaagtcaaactagtgcctaaatgtgttttcatagtccctgaaagaagcaggagcagaaagacaaatgctcagtgctagatgttagctatgtgctcatacaatcagatcatctgtctaagcacattgcttttccctggggacctgaggatatactaaaatgttgctatcaatttcatacaattgggtttttttccacagagcaaatgataaaaatgcagttcaagagtttatgtgtaagtagtactcttctttgcatctgttttaatattcaagttcaaatttaaaaaggaaaggcaagatattaccaaaaggaaatgggcatataaagaaattaaaaaaaaaatcttcaagaatgatgagacccagtggtggtaaatgggaatataataaatgcccctgtaaggattttaaaatcatctataaaaaaggggaaaatgtgctctctatttttaaacccctcatactacataattctgagggtatctgctagcactaaataatgtgatttaatgtggcacttaaaattctataggaaacagacagaaatctatgactttctaacaacagatgcataaataaccaatgatttttttcttttacatcttgtaaacattcttatgagacgcatatctatacctatattcccttagctataagcatctgactcatttttgtacccagaagaaggaattcaacttgcttccagtagaagctgaggttgggtttttaaaaacaagaagactagaagttaataggaccaaaccatatttggatagcatagtagaatttaggtatttttttaaaaaaacaaattataaaatgaatttttattgtgataaaaagcatatggcataaaatttcgcatgttaaatttttttagtgtatagttcagtaatgttaagtattattgacatggttatagaacagatctctggaacttttacaccttgcaaatctgaaacactatatccccattaaacaattgttctttccatcctcttccaagcaaccaccattctatttgtttctatgattttgactactttacatacttcatataaggggaatcatacagtatttgtgtttttgtgatttatttcacttaacataacgtcctccaagttcatccatgttgtagcatttgacaggatttccctcatttttaggccaaataatattcttttgtatgtatgtaccatattttgtttatctattcatccactgatggacacttaggttgcttccacctgttggctattgtgaatagtgcttctgtaaacatagaaggtgtgcaaatatctctttgagatctgctttcatttattttggataaatacctagaagtaggattgctggatcatacagtagttctatttttacttttcggaggaacttccataccgttttccatagcggtttctactttacaacaccaccaaccatgtacaagggttccaatttctccacatcctcaccaatacttgtaattttccttcttctttttttttaatagtaatgattctcatgggtgtgaggtgatatctcattgtggttttgatttgcatgtctctgatgaatagggattttgaacatcttttcttttcttttctttttcttttttgtttttttggagacagagttttgttctgtcacccaggctggagtgcagtggcacaatctcggttcactgcaacctctgcctcccacgttcaggtgattctcctgcttcagactcctgagtagctgggactacaggcgcttgccaccatgcccagctaatttttgtatttttagtagagacggggtttcaccatgttggccagggtggtcttgaactcctgacctcaagtgatctgcccacctcggcctcccaaagtgttgggatgacaggcgtgagacaccgcacccgcccttgaacatcttttcatatgctttttggcatttgtatatcacttttgcttaaatggctattcataggtatttattctcatgcctccaaaaaacacaagaaaatgccatgctgggtcagccccattttcttctctaacaagaatacttagagttgttttgtggaaaagagtcattactggcaaagatatcaacctcaacatctctactaacaactatataaaggagaatttcattttatttgccctgtgattctttcttccaaatactaagccacctctgtccacatattgcttctaaacctcggacgccaagtgttgataaaaattccatgctccgtccacatcgttcataattttaagagcttttaaatgaatttctggatacctatctaagctttaattttcctaggcttaagtcttagttctataatatattctcaaatagaaatactctgtagtctagatcgttactatcgtgatttgcaaaaaaaattttttttttttttgagatggagttttgctcttgttgcccaggctggagtgtaatggcgtgatctcggctcactgcaacctccgcctcctgggttcaagcaattctcctgcctcagcctccccagtagctgggattacaggcatgtggcaccatgcccggctaattttgtatttttggtggagatggggtttctccatgttggtcaggctgttctcgaactcccaccctcaggtgatctgcctgcttcggcctcccaaagtgctgggattacaggcgtgagccaccatgcccagccgggagatcctttttaaacctttcagtggttatcatcccttctcctcttttattcagaagcaatatctgccctatctggtcaactatctctggattgcatattccttgaggacaggaaacagtcttaatttctaggtacattgtctcttacttcagaggtattcgatgaatacatattgatttgtatgatgcctttgtttcttctaaatgggtcttgaatcactatgcagaaggaacaaaggttgggtagtctaaggtaagtgttctatttgcgggcaaatatttcttggcttgttgaatgtaaaaacaactatatgcgctcatttcattttcacataatctaaaataaataaatcaaagaaatagttgattcacatttcatgtcttcttgtgagatattttagtcatgaaagaattactattaataattatactaataatttaaagataattgctgttaatgataatggcaacatcattgtccacttactgaacatctattatgtgccaggtactctgctaaagtacttcatgtgctttttctcactgaatcctcaccataatcctataaggtagatgatattatctgcatttcataggtgaggaggctgtgggtcagataataggattagatacatttcatcaggttacacaattggtaaaaggcagagttggtaatcaacttcagttttgttgattgctagaatgtaagctacatgaaagtacaaatgcctatcttatttattactgtatcttcagtgcttaaaatggtgcataataaacagcaggcactcaataatattttaaaatccatgcctacaatatcactcataatattaatcattgaggtagtatgatcttcttaattcacctggtcatctgatatttctcttctcaaagatgaatacatataaacttcatatttcactgaatatgtttttatggaatttgttttcaactcttaaaattacagaaatgatcaaatgatatcaggaggatacttatcatcattgtgaaagtgaggtaattgtcatggctccctgcttagaatgtgggggacatcagaaaagtttcatgcagtactgtactggactttcccatgtcaattaatataaacataaatataaattaaatataactaaatataaattcaacattctttaacaggatgtttagagataaattgaaagtaggagtaagggcatagatacataaatggtatagaaagaatatactacatattttacaatgtttgatcaagttgctttagtagacctcaaaactaattaaaataaataattaatgcttctcttcataataatgccctttcaagtcaccctttcattctccttccccaagttagatccatgttctgttaacccaactttaatttaaaatttgatattaaaaaactctatatcagttgaagagtaaataccaaattaatattttctattaatgcaaatgttcctgtattaaaaggctcaggccaacgtataaaaattatttacttagataagtaagcttatcatattttcattctctttatatttaatgctaatttaggttttgagataatggtgtggaagctataatcctttcaaactacaaaataatgtggaaagctattggtaggtgagcttatcaatcctcttacaattttatacattttccctatggaggaataatggaatgccaccctatagttttcagtagttcattccctaacagagactaatcaaaataggaacaaacaggtgacgcaggaaatacttgtgactatacatttaaaagtaaatcagactctaaatttcctaggacttaaaaaaaaaaaaaactcttcattttgtaaagaaactcaattacatttccctttgctgaaagtcagttcccaattttactcaacagagaaactgatgattttataaaattgatcttcagtggttacttggattattatggttatttttttctttatacaggagggggtagtgggcagagtattatacacttttattacctcttttttcatcttctcttttctttttttttccttttcttttcttttccttttcttttcttttctttcttctttctttctttttgagacacagttttcactcttgttgcccaggctcggtgcaaaggcgtgatctcggctcactgcaacctccacctcccgggttcaagcgtttctcctgcctcagactcccgttcaacttcattttccacagacatgtcttttcctggtttattttatgagccagttgacatggtatacttttctgtatcatttatttttattgagttataatgtacctcgataaggacatcttatataaaaaaaagtttcaaattaattacaaagaagtacaagaaggacagagcctaagagtttctcactaaacacttcaggttgaaaatctagatcattatgctaatgcaacttttgaaggatcttgatcaacatttggcttttatcagcttttatttctttgaaagacttattcatacatgtacattaaaggtaagaatattttataatgtcataaattaacataagaaatgccactcaaatcagtcccttaatctatccagcataacatttttcttctctaaagaacaagctggcaaaacacatgaatgtcctttgaaatagcctcaaaataaaacagccagaagcagagactgcttctcaccaacacccatgttctcctctcttcctgggcacacaaatggagtacaatttcccaaccaccatttttgttaggtgtggtcctgcgactgagttctggctaatgaaatgtaaagtgtgagcaaaagtgatgtctgacacttcaaggcttgacccctaaaactttccacccatgatccccaatctccttcctcatccactggctagaaaaaagcagacccaaatatggaaggagcctagtacaattgttacaggtaaataggcatgagtggggcaggagagggctctccctatcacccactagaaatgtccattgatggttcagcaattattgcattgcctttcaaacagtgacaaattggtagccggtgccatttcctgatagtccacacctgttaacatcaaaatgttaattgaatgtaggccccaaggagaagcaacttcctggacatgcacatcaagagacaaaaatagcgaagtatgatcttccgggtacacgccactggaaaaggaaagaaagcctcagatgggcatgtgtataactccctaaacacactgtgcgtgctcaattccaaatggtaaggaacgcactgagtatgcaggaagcccaccctaagggtagaatcatgggagagacgagcctataaagccctaggatcaaagttaaaggcacctttttttttgctctcttttctcccttggaccttcaggtgcccccttgagtctcctccaagcaaattttcctttctttccgtcctgaagacttttaaaataaacttccactcctgctctgaaacttgcctcagtctctttttctgctttatgcccctcagttaaattctttcttctgaggaggcagggactgaagttgctacggacccatatggatatgctgctggtcagggtaactcagatctcttctactggtaacacattcattccatggaatattatgcagtcagaaaatccaaagaattggtaaccacataagcatattagatatgtagatcattgtctctcagcacagagacctagacaggacatccatgatccccctatgcccactccccactgcctgcagccatagtccagaattggataaccaaacttagaggcaatcgtattctctctttctcactcagaaatctagacatagacacacaactggggaagccaagatgcaaggtcatgttgagccagagctggagttacaacattataggggaacagacaaagaaatcccatctagagtgaagcttgagaatggagcatatctctagagagaagaaaagatgagacatcacctggtcccagaaagaaatagaatgatggagagagtttcatctttcattaggcctggctgtacttactgtgcttttctttcactgtgagattactctgcatcttaaaaaaaacctttaaaaagtttaatttagttgtacaggttttctgctcccagtaactagataattttccatattgagcaagaaacagagttcatgcatatagtacaaccacaattacgtgctgtcccctcccacacaaaaccaaaagcaaaatacaaccccaaatccccattccacagacatctgatctagaagaaaacaaaaggaaatcttaatagtaagtatctttggatgatggaaattgtagttatttttcctggtgattatccatgtactttctatttttgaaatgaaggtatactacttttataaggtccgtcatgacctggcctctgcaggcctgtcagcctcactactgctattgtctacaatgccctctatacttctagccatcctatgttatgtgcatctccaaatgggccatttttctttcaggtttctgtgtccttgtaagctttttgcaaagaacaatatcagaagagctaagacatgcccccaaatagtgcaggtctaaagtaaggcaggaaatagaggacaaaaagtgaacatagggagaatgaagagtataagagaagagaaaggaatagagtaagaaaagaaatcttacagatagatatggctgtctttgcaaggttagaagatcattcgttagttgcttcaggggtcactctggtctcctttgctataggttgtttagttttgatctaaataaatagtcagcaatgacacactgtatttttccatctttatgcattaccagaaaacaagtcaattaagtatagtacaaacagggtatatattcaatgtgtcaaaaatgtatttctcttgcttaagactctcacatagaaatgcaggatatgacaagttaattggggataaaaattatatgacgagttgccattgcattaaaagtaaagcaatgcagagaggctcagatttaaatggatgtagtttaatggtttctatcccaaactataaactggagaattgtctaaacctctaacaaaggccttggaagaaaggaataggaggagggaaagatgggaagggaaaaaagaaattaagagtttgaagagtggtttgagtaaaaagtgatccagcaacaatagattttgtcttaccagtaccaggactaagttgggaaacatcgatggaaaagaatgtttctcaaactggctacaaaaaaagtgtttctcaacaggggaccaactggtccatggggaatatttggcaatgtcagtagacatttttggttatcacaacttggggaggggtactactggcatctagtgggtagaggtcagatacgctgctaaacatcctgacagtctacctccttaagacatatgtaacaagaaattattcagcccaaaatgtcaatagtggtgaagttgagaaccatttgtctaaactcttcatccaattggaacgtgaagttttgaggtattctacatctctacaggagaaaatctgtcactctgtaaagactcccagaggaagattttcatgccaggcactcctgatcttatcttcctccccaagctcacagctgttcctccttgatgctctatttgcacttgggattggtctattatccaaacaaataccctgaaccctagggccagagagcatatacaactcaccgataattgcctcaaacatttacccttactgaccaaacaaggaaatctttgtaacaataaaaaaaaattgctttttaaactgtacccctcatgaacctgtcatgaggcaaaaatccaaaacctgaactgattaaaatatgcagaatatataataatcatagcaattgaaacaacattaactcctcttaggttaggtcacttaagaaacagtcaaattcagctttgtgctatgctctaaagcttagtgactacaattccacttgagcacaggagaatttgtggaaagcaggcctgccttccactaaaatgttctctccctagttccctgctgtgtggatttgagagtgcaaagaagaaacacattggttcactttaattattcagggacagcacagagagataaacaaggtaaggtcaacgtcaagaatatagggatttcatgcactctgctgacctctaaatatgcttttgtacttggcaaatataatattaaacctggacttattttttctatgcatcattgcctatccttagaaaacaaatatcatcacggattcacggggtgcagtatagaaatggctggttgtaacttaaacctaaaccagattatatttttatctttcaataggaaacataatatgaagctgtatttatgtcatagactgagaatgacaacatgaaggaagatattgaaactgtactgcagcctcacacacagtatgacccaaggcagagtagacttctatacaaggtgttgcatcttgaatcttgtcactataaaggtgcaaaccaaaaataaaattcgaaggccccaaatcatccgaatggacccctcctcttggccaagggcatttcagagttaacctgaaaatctaattcaagccatgatggaagatggagtttaacatgcctcgttatatccctccagtgttaacatcaacatagaccttaagtctgataagaaacatatacagtctattttctctaaagcaggcatcatctgcatgataaaacctaagtctccacaaccccttattgtaacccagacattgttttctactaataattctttcaactaattgccagacagaaaatgtttaaatctacctatgacctggaagctccccaccttgagttgtcccacccctccggatcaaaccaatgatgtaaatcatacatgtattgattgatgtattaagtctccctaaaatgtgtaaaagcaagctgcaccccaaccaccttgggcacatgttgtcaggttctcctaaggctgtgtcaccagcgcatccttgaccttggcaaaataaacttcctaaattgactgagatgtgtctcagatattttgggttcacaaagggttttgttttaaaaatgcatttatttaacaaaattgtatcaagcacctattgcgtaacaggaaaaatgacttcatagactagtcttgcactggcctaatgttgcctccttaactatagttgcctgccatcatcactaccctttgacagaaagggaagtgtggtgtcttcttcagttcttcttgcctataggaaattcagaaagaatcatgactgctcaacttaaatctatctcacttgtttggggacctcacctggaattagtaaacttgcaattaattagaatccaactaactggaaagctcaattaagcaggattctttcagtggaggagcaagagacaagaagcaagtcacagaatgacagagattgtaaagccagaaaggacctcgaatatcgtttagcttcatttcctcatctgactattgaggaaaatgaggttgagaagaagaaagggatatcaaggttacatagctatttaatagtgaaattggacttggactcaagatttctaactgtaaatctagtgctttttcaaaaactcacacggggccattaaaaatttgcaacggatatcctgggaccactagacattttgtccactctacaacatccctttatacctagaacactttacaataacaactcaagcttaaatggcaaccctgatgtactataagattttcaattataaaagattaaattatgatcatttggattaacatggaaagtagattcatatttaagaatgattttcaacaaggatggcaatttgtaaaaagttctatttaaccttaagctaaccaccaaatccaattaaccagaatgccccagtttcctgggcatttaagattttaatataaatagaataaaaactagattatatctccaggcagggaaacttaaccgaaccataaatattcactgaaagacaaaaagagatggcgtggagttctttatataccagagacaaattgttatagtgcaaagagcattggattgtttgcacaggacttacattccaacaccaaatcttgctccaagaaattttaataatttaataacacatgctccacatgaatgtgttattaaaatttcccaagactcagttattttaccattaaattgggcatagtttctattatgtctactttccagggtttacagtttgaaatgagataactagtgaaaatactttggacaatagcaaattatgcgtgcatacttatatatgtacacatgcctatatgcacgcacacaaacatacatgcatacatatacagtacattatcaaatagctaagccttttgattttgacagacaagaaaaagtatttagctacaagtgtatctactaaaacacaactacccacattaccataaaattacctaagttaatgatactattcactatggtaaatgacaaaatttgaaagattagactgtcatagataaaaacaatgattttagttgaaaggtgagaaaaatatcagattgtgactattttatgccagaagaaattcaatttacttatgaagctaatatcatgttgtacttgatattttgatagtttgaattggaaatagtcatgttagcatctatgctgtcaatgcaagctctgtgcatacatatgtcactattaagtatcttcttcagtaacaagggaccgcctagtgttttttgtatgccagatagagataaaaagttcgagttctaattgtgtcttggccagtgataggtgcttgccctcggaaatatgatgtatatttgagaaccaactttagataagagtgggaagatgtaatatcacctctactgtgagaataccaaaggcaaactttttattttattttaatcctcctcccaaaggtgaggattaataaatccccagctcggccaggcgtggtggctcacgcctgtaatcccagcactttggaaggccgaagcgggcggatcacgaggtcaggagatcgagaccatcctggctaacatggtgaaaccctgtccctactaaaaatacaaaaaattagccaggtgtggtggcaggtgcctgtagtcccagctacttgggaggctgaggtaggagaatggcttgaacccgggaggcggagcttgcagtgagccgagatcatgccactgcactccagcctgggcgacagagagagactccgtctcaaaaaaaaaaaaaaaaaaaaaaaaattccgaagctctatgtccttgttgggacttggcaacctgggaagcctgtactgttgtatgggatcatgttgttttcttctgaattatgtgattatcactgcatatttctatatactttatcattaaggcaacttgatctctgactgggtctgtttcttcttgtcactcacagcactatcctgatgtctagtgtatacctcctcactaatgtagtttcccttgtattttgccttccaattcacatgaaagttttgccctgattcagtctgctctcaatctactgccccatttcaaaaccctactttaccttttgtttccattttcttagctcttaccaattcttcaaatccaacgtggtatgtggcttcaatctcactactgtacagaaattggctgcttaaaatttataattgatagagtcaatggtctcttctcatccatagtttatttgattcctctgtgatatttgaaaatcatgatcaccacctcctggaaatttccttctgtttgttctcttccgtgattacttttcagtcacctacgctggcctttctcctctatgaactcctaatacataagtgttgccatggtttggtttttggctttcttttagtcttgcataaaactccatctaggtttttcaatacttactattattacatttacctatgaaagtcttaattatctacgtccatcatgagctctggaagcagacatatctggtgggtttttttttttgttttttttttttttttttgacggagtctcactctgtcattaggctggagtgcagcagcatgatctcagctcactgcaacttccgcctcccgggttccagcgattctccagcctcagcctccggagtagctgggaatacaggcgtgtgccaccacgcctagctaatttttgtatttttagtagagacggggtttcaccatattggccaggatggtcttgatctcttgaccttgtgatccgcccgcctcagcctcccaaagtgctgggattataggcatgagcaaccatgcccggccgaagctgggttttaactgactccactacacgtaactgatgaccctgtggcatgttgttcaacatttttaagccttagttttaataacactaagttaaaataaatgtgacagttacttggaaaaatacttggcacatagtaagcaagtagtaggagaatattttttctctatttattcctttccttggactcagatccatattttcaactttttttgatactgaacatttcaaactagatggctcacgtaggtgttccaatatttccaaaataatatgcactgtctgcttccattaacttctgttcctgatttcagaaatctactctatctgtagttctctgctcacttactctgtccatgcattttgttgaacgatatgagccaagcactgagggatcaacataagaaaaggcatagcactttacttaagtttcagtgaggaacaaagacaagtaaatagaagtttttgagggcaaatatacaatgaaataaggcgttgtgataaacatattggcagagtgttatgagatcatagataaggggtttctacatgaaagttgaagtggggaggttgctatagtctgaatgtttgtgtcccttcaaaattcatatgttggccatgtgtggtggctcacgcctgtaatcccagcactttgggaggccaagacaagcagattgcttgagttcaggagttccagactagcctgagaaacatggcaaaaccccatatctacagaaaatacaaacattagctgagcatggtggcatgcacctgtggtcccagctactccacaggctgaggtgggaggatcccttgagcccgggaggttgaggatgcagtgggtcatgattgtgccactgcactccagcccgggtggcagggcaagatcctgtctcaaaaaagaaatcatatgttgaaatcgaatccccaatatgttgatgttaaaaagtagggcttttggcagggtgattaggccatgagggttctgtcttcatgagtggaattagtgtccttataaaagaggcttcaggagcctgttggccccttctgacatatgaggacaaagcaataacgtgctgtatatgaagaacaggtgcttaccagacaccaaaatctgctgacaccttgatcttggacttcccagcctctagaaatgacagcaatcaatttatgttgtttataaattacccagtctaaaacagaggtgatggcagactaggaagactcctaagaggtatctttgactcctctccccgttttcccatatcccatctagccagaccccaagtcttgcaatattattaacctcaaaaaagatcaatgttttaggggaaaggctctctccccctactagattgtaagctcattaaaggcaaggtttttatttgttttgttctctgttgtagccccagcaactagaagagtgtttggtttaaggtaggcacttaataagtatttgttaaaatttgatgaaactaaaataaattcattatattatttataatgaactgtttttcatttaaagtatttgcattatatactttctaataccctcagatatcacaccaattttttaaacaaaatagagaagcagatgttactgtttatttgcttatctgttcaccaaaggggacaattctttttgagctttcttgttctttaaataaaatactcagtaccacactttcacaattcttgcaaacatatttcaaagacctcaagacttaaccagatcttatcttttgctttgaaagctacaaacatttttgtgttatggagttaatacagaaccagctggattcttctaaagggagatgcttagtagcacatctttttgatacacacatacacacacacacgtgcagatacacattaacaccctgatagaaaataagaataattgacaggaaatttattttctgctgctttaaatatatttcatgctcttagtaaaatagacaagtatctattaacttgacatggtaatggaaatatttgttatgattcactggataagtaactttgcagtgaatgaagttgttaagaacttgtgttctctcttgttcaaaaccatacatctctgttttaaatatagtcggtatagggaagtgtataagtatatggtgagggagggcaaaatgatgggtacagagatttcactaaaatttaatttttgtttgctatactcgtatattacatcaatcaactcatttttaaaaattccctaaaacatttttagattcacatttgcattgccaagtaaatcttctccatattaaaatcagatttcatctcacctatggtgaagcattctttccctataaaatgaaacaaattatgtttgcctatggttttattttgaaatgaaactgagaatagtcagttgaaaagcatgtttaaaaataatgctgccaccaaagtaactagagactgtatcacactgatctccaaagtattgttcttcactgcctaagcacaatagacttatattttactctcaacatgtaaaacatattttaagactacagcattctctttgatgtaaatttaacatattccacacccatcatgtggtgtaggctgaaaagcttggttgagcttggttaaacaggatttataggtcatagattagttctacagcgtcttttcctgtcttaaaaagaatctttaaatctgtggctgaagatagatttttgctaacctccgtgctgttaaaggattaaagcctgagatactgttggatctaagcactgcatatgtacattttgagattttttttctccagtcattattgaaggaaaaaatttagtctctatttttccattgcaaatgttctagaaaaaaactacttataaatgttaggtatattttagcagtgctgtataataaagacatattactgctgctggagaacttacatttattggttaatacttaaagggtatttttccataaataaattactgcaatcaccattaatgagtatttcctccaaatgattcttttttccccaagatagaaactagctctggaagtatagtaatacacattggtcatataagtttcatttctgtttccattccttgccaaaatctcctttgccaatggccctggctcttcttttgtaaaaataaccctgtagactccatttaattgtcacattggcctaaagccatcaagggcagttagcctcataccaagctgcagccatctgtcagaatatgctaaaaatcaatgaagatggttacttgcactctcctgccccggcatgattcctccacacaattctgatttgtctttgtgaactgaagtggtcatgttaatcccaacaccaggttttctctagtgttgataatcacagcaaaacctttgagtaagattcattttggtaaatagatcatgattactatccattatcatcattctgaaaaaataattaccatctaagatcaggccaagcaaaattagttgtcttgaaccaacacttggccaaaaattatcatgagtaatagaatatcaagtagactctgaattaggaatttgaattgggggacagcaaagagagtaaataagagtaaacaaaaatggctgcaattccacttaaaagtgaacctggatgaagaggctgagaagcaaagggaactattccagtgctctgcagcaagggggctgtgtttgaattcctgacagaaataagcacctcttcaattaattgggtgttaaaggcaggtcaatctacttgcacataatttcatggatagaatgaaaaaaacattctatagaaaagaaggaaagcagtaaatcatgattgtgagaagctagaaaggaataaagccagtgccaggggatggacatgggaagaagagaaagaagaaaggaaactaaaatgagggtgcaaatttcatgtgcggtatgaaataatacttgtaacaaccttataaagtgagtgctattaacccatttttaagttcaaaaaactgaaattcagaaaggttcagtaatttgcctaagctcatagaggtaataagaagcagaatgggactttgaactcagttctattgttttctttttttttatgttttaaacattttagaaaatatttaatctcactaataatagcaaatgcaaactcttaaccagtcttacagaattttatcaagcagtcacaggactgtgccaccaaagccatatgatacctttgggattgaggctcatgccacagggaagaaaaagagactttctgaagaaaaaaaaaatcaaagaataaaagaaagaaaggatctgcaaactctagtatatctaaggatgggcctctggataaggaaggataatatggaagtttaacagcaggaattttagcatgaaatttagatttctggctcatagcttgagaatgataggttttcagttccagaatggttgtctctcattagtactagaaagaacatgcttgctcacagagtggccaacctggtcaagagtatttaaatggcaaatgaagaagggaaagaaataataaaaagaatagtgcctaatatcacttagataactggtgactatgcacaattttgattgtgatatgttattcccagaatgccctttcctccatttttcacttagtatcacctcatgattttagaacaaaatgatttttaggccattttctcagggaaatttcgactttccccccttctacctacctgaacacttccttagtctctactattcctaccttggttagatctacccccctccaagggttcttacctttggattacttaaatataacaaaacacttgtgatggtactgttatttatttacctttgcttcccctactacagaaagtcagtaatgcatagtggttaaatatgaagatgctagacctacagcctaggttcaaaacctgacctggatctgtcatatcctacctgtgggattttacaaagttccttaacctctctgtacctcagttgcttcatctctcaattgaggatggcaacactaaatagtacgtaccacatgggcactagcatatggattaaagaagttgattcataagggcttagaatagtgcttggcatatagtaatgctgtttagcatagttagatatcgttattgttactagtactaaaccatgcatttctggaatacagggattctcattcctcatagaagcggcagtgcaccaggaataactagtaaatgcttgctgaatgcctcgctgtgcaggacacgcacaataatccatagactgggaagtatatgtgaatactggatgtttttacagcagattaaagctattgtgtctctctgaattgtagtaactctgaattcatctacttgccagcaggtctgtgccaggctattatactgaattgaaaatagtaatatttattgcacactttctatgtgcctggctctgagtagacattttcatatattatctcattcagttctgaaaacagccccatgaggtagggtctgtcatttttgacacaaaacaaacagggaaattcaggtctatggaagttatgtcatgtgtctaagttcacaataacataagtagtttagtccagggatgttggagtacatatgcttgcacacatcacccagcctctccatctttggcaatgtgcccatctttccgggttgcaaaaaacaccctgcccccaaaatataatctagacattgggaattttgagaagaaggcttggagaaggagatagcaaggctgacgtctgagtaagggagggctcagggcagggcccaatccccaatgtactgggtagacagggcattgtttttctgaataacacagaaggcaggcagcaatgcacaagctgttttgaagattgatcacagggcagtcttaaaaagcctcacaggtatgtatcgtcaaaatgtgggagaagggggatggttctgatgatttggaacatggtggtgaaagagtatattctatttatttatttagagacagaatctccctctgttgcccaggctggagtgcagtggcgcgatctcggctcactgcaacctctgaaccatccccactccccgccggttcaagcgattctcctgactcagcctcctgagtagctgggattacagggacctgccaccacacctggctaattattgtagttgtagtagagatggggtgtcaccatgttggccaggctggtccggaactcctgacctcaggtgatccacccgcctcagcctcccaaagtgttgggattacaggtgtgagccaccgggccaggccaagtgtattctatttaaaagcatgctaagagaggaagtggaatgatgttgtatatgtttactttgaggaaattatgaatggaagggtagaaatacctttagttagataaagatagcaatagggacaaaaagtaaaataatctcttgtgttattattgctattattattactaatatttacggagtgctcattatgttcatggctgctctaagcacattgcaattaggaactcatttaatgctcacaatggccttatgagctaggttttactattatccttactttacagatgagaaaaccgagacatggtgatgataattaatgtgcccaatgtcacatgactaataggtagtggattggagagtctataataagacacttggccagaaggagacaacggatgctgattttcaacacagatcacaaaagcgtcgtaggaggaaagggtagtaaacatgagtgatttcaactccataaacatctgctagttgtatcgatttgcaaaatgcaaatatatggcaagttcccaaatttttgtgttaatgactacacctcccaaaaggtagagaaaataagaaacttgcctctctgactgacttagaaaaagagaaactggtgagttgaaggtgataggaacctttagaggaagtgaagtattttatcttagagtccataagtaccttataaggcccaaatcccagactttaggaaaagagcttgctgaagtaaagtaggtacaatttcatgccctgagatactctaatatggagatgaattaagagagttgggaagttattatattttattttttttaacctgttgaaaccagtgtgtctgtactgggtgttatccattcacattcagtttggatttcaaaagaacaggtgccaaaataaagggatgaaaaccaaaaataagtaagtttaagagggcatgatgaaaataatgctaagaagaattataccccaaatgagcctgaggcttgagaaaaaaactgctaaagatgacagaaaagtgctttttaaaaaatatatttaaaccaagaagagcaagggtaggagagacatgcaacccatgaaattgttattggatggccaatatctgagaggccttctcaactactgtactagttttctttgtgaaaaagaatgatgatagacttgaaatggtaaaatcaatatcagtaaccataaattgaagctaaaataggcaaagcagtcattaaaaggcatttggctgttctataataaatgaattaaaattctatcccagagtggtcagaggtcttggagattggattaccctgtcacagttgctaaagttttagcaactgtagtgtggttgaagtgtgacaggagactagaaacagaaaacattggctttagttttcaaaataaacaggaagcatatggactccttagactagaccaagaaacaggttgattaaatacaaaattctacaacaggttaataaaagaacagtttgtgagcgcttaggaaaaaagtagtaaccataagaaagcaagcagtataaattctctaagaacaagttatgttagacaatctcatttcatttctattcttgacatggttattagattggaagatcggtaagaatgtaagcatactatatctgaatatcagcaaggcatttaacaaggtctcccataatatggctatgaacaagatggagaaatgtgggttgttagtaaaagaatgttgcctaatagataaatgtcaccagtggcatgcacagagatctaaccctaatctggtcttatgtaacatttgtatcgataacttacataaaaaagagggaagcatacctaacaagcctacagatgacataattctgagagcaaaagcaaatagtttgtatggtagaattagaactcagcaacatttccacatgctaacaagatgagatcaaattaggccaaatcaaggctccaaatatatttccactgttatcttccataccaaacacaaaactgaaaaagaatcaactatgtacttacagaataaataaaacgtggtttagcttcagaacatgttaaacaggctttggggtttagtttccggtgttctcaatgtgtatggatagtgtcatgtggccaccaaaaaagctgatactggagtagacagcattaacgaaaatacataattagaacaagagaggtggctaattgttggtcatagcataaaatcctcagtgaatcagtcaaaatgactgactgctgagagtcccatctaaggaacatcaaatctgctcacggtccttcctcaagggacaaccatagatggccatgttgtttattttaatcacatgacttttctctccccgtagcctcagttgactatgagaataattgccagggcttgccaaaaaactgaaacacagcctgctataaaagggatgaactgggctaatcaaattccctcttagggttttgagcctacagtgaccaagataataatgcagttagcaatgggacatgcagctgaagggatgaggtgagaggtgtgaggaggtactcttggagtcatgtggtacagtggagaaaagacatcgttatgagatagtagaaactatgtggtagacaaaataaatattgagctgatggaaagaataagctattggacaaagaaacagacagagaggagcaaaaatgcagagaactgctgagtcttattaatgctagagatccacagtctttgcctttcctttggggattgaccagagtttcccgcgttcccggggactgacaacacatacactgaaaagatgttctcaattactcgaggcaacctgaatgtctctggcttcttgcaaccagagaggctaataagaacccacacctgcattcagccttgaacattacatttcaagagcagtttggacaaactggagtgttctaaagaaagagaccaggaagggagatttgaaacccattaatgtgaggaacaggttgaaggaattggggaaacatttagcacaaagaatagaggactcaagaatagtgaagggctgtcagttgtaaggggaattttacttattctgtgagaccctaaaattagatttgagaaaaatgggcagagttaagaagggatagattttggttcaaaaagaatcttctagtagttgtttgaggtagagtggaataacttaggaataagccaattacctattttggagatatttatgcaaaggcaagtggccacttagtagggatagtaatgttaccttttaattgtgtagtgctttacagtatatgaggcactttctactacgttagtttgattttcctaattaggaagtcaggcatttgtatattcatttttacagatgaggaggctgaggctcagacaggttctgttacacagttcatgtataagttcctggatacccacagttacctttattgactacatgagaaatgaacattttaaaggctatatttgaacaatgctagttgatagagctaataacgtttctggcttttaaaaaatcatcattgtgatgctaaatatatgttcaaatgtactaaaaaggtactctgttcactcttacatgaaaacttatgttcttctctgcgtcttaagaaactgagaccaattaatatattccttgcatagatacagaaggtccgtgggtgcagtttgtacaaacatgcctagatgtacatttcaaataagaataattttctctctccatttgcctgaacccattccccactctctcccagattttctgttatttggcttcaaagacgaaaggagtgtgtttgcttgtcagaactgctacttaaccatattgccctgttgtttcctcagctctctatcactaagctctgcaaatgaactaaaagtaaaatgaggaaataaccactgtttgaaaactccttgaagaagatatacattgttctttgcattttaccctttactcacctccccctttcaattaaaaaagaaagaaaagaaaagaaaagaaaagatacagggctgggcacggtggctcacgcctgtaatcccagcactttgggagggtgaggcgggcagatcacaaggtccggaattcaagaccagtctagccaatatggtgaaaccctgtctctactaaaaatacaaaaattagctgggcgtggtggcatatgcctatagtcccagctactctggacgctgaggcaggagaatcgtttgaatccaggaagtggaggttgtagtgagccaagatcttgccaccgcactccagcctgggcgacagaaggagactgtctcaaataaataaataaataaataaataaataaataaataaatacagaaactctatcactagtatagttctaattgggttattgtcaccataggtgctgactgctatatttttctcttggaatgtagcagaaatcaccctttatgaaaccatttaatctggtaagtgatggatgatactgtttcctggacatgggccatagtacttgcagtttgttgatggtgaaatattctctgatgccatggttggtatttaatttaatatgctgctaaacaacaaaaacaataacaaccagtcttaggagagttgactagtccttctctttccattccaattcccagagatcagattagaaggtgataccagacattgtttatcaagtagtatattatacccattttttacatacaaatgtctttagaaaaagtttctgtaaattggatagctataggtagaaggaaactggactcctatccctcactgtatacaaaaattaactcaagatggattaaatacttaaatataacaccagaaactataaaaatactagaagacagcctaggaaaaaactcttcaggacattggcctaggcaagaaattttatgaccaagacctcaaaagcaaatgcaacaacaacaaaaatagacaaatttggcttaattaagctaaaaagcttctgcatagcaaaataaataatcaacagagtaaacagacaacacacagaatgggagaaaatatttgcaaacaatgcatccaagaaaggactaatatccagaatctacaaggaacttaaacaaatcaacaagaaaaaaatacccaaaaattcctgttaaaaagtgggcaaaggacatgaacagacatttctcaaaaggtgctgtataagtggtcaacaaacagatgaaaaaatgctcaacattattaattatcagagaaatgcaaattaagaccacaatgaaatacgatctcataccattcagaatggctattattaaaaagtcaaaaaacaacaggtattggtgaaaatgtggagaaaaggcaatgcttatacactgttggtgggaataaaaattaacacaacctctggaaaacagtatggcgatttttaatagaacttccatttgattcatcaatgcacttctgggtatctacccaaagaaaaataaatcattatatcaaaaagacacctgcatgcatgtgtttatcacagcacaatacacaagagcaaaatcatggaatcaacctaagtgtccatcaatgaataattggatgaagaaaatgtggtatatatacaccatagagtaccacagagccttaaaaaaaaatcatgttttttgcagcaacatggatagagctgtaggccattattcaaagtaagctaactcagtaacagaaaatcaaataccacatgttctcacttataactgggagttaaacaatggctattcatggacataaaaatggaaatgatagacccttgggactccaaaaaagggaggatgggcggggagtgagggttagaaaattacctattgggtacaatgttcaccctttaggtgagggtacactagaagcccaaacctcaccactgcacaatatatccatgtaacaaacatgcacatgtatccccgaatctataaaaataaaacaaaaataaaagcttccattgtagaactaaataaggcacacaaaaaaacaaggggaagtccttgaatttcaaagaaaatagaatctatgttttattagttagtgtttttctatgtcaatataaagttgtaatgtttgatttaagaaagtgactagaaatgatgaataatttctttattaattgtatctggtgctaaaatctatcatgatcaagggacctagaactgcaaagagtagaacttttatcatgacaaagctctgaggagtcaatctagaaatctaaacatgtgaagaaaaacagaggcaaacttttttgctcaaaagaccaaaagcttcaccctaaaggcagaatttagtttttaaacttacacatatacttccattacatgaggctgatcctttttttttttaatgtttgaaggcaacttattttttcaaagaatcttacaataaataaaatagaaatgatcactcctcctccagttgtgtttgggttttcttgtaatactgcagttttttaaaacaagggacaattgcctttcactttgaggctgcagtgacagcttagataattgctttgttttatgtttttgtggatatgtgacagcagggtgtttatgtatctgcggcttcatcttttcacgtgtatctgctttggtctgtggctgtggctggatctagatgtttgtgtctgtttgcacatctgcgcctgtgaaggagtcttcctttttgcccatgcatctgggtgtgtatcggtttgtgcatttgtgtgtctctgcagatgtgtgtgatgaaatgagtttctgcaatcagtagaaccatcctctgccaatacttaagtttagtgggatcaataatagctcaagtacctggtctccaatggtatgttgctgttcaggacccagctgttatgcagatggactgaatcctgcgtgctggttgggggagctggagcagctgggctgggctggctgcgggtagtcattgatctcctctgaagagagtccgctgcagggggtggcttcctggcacaggtgcaggcatgaggaggcggaggtggcggtgggaggggtctgaaggtgaactggttgtgtgggctgctctgcacatctaaagaggagagaagagaaacataaaatagagacttactctcccacttggcagtcagggaaaccagcatgacagacttaccaggatttcagataataaaacctgtggggtgagggaggttgttttaagttcagtctatctgtaaaaatgccacttaacttacaaaagcacgtgcagcatgcttatgaaatgtaaaacattcacagttgcatttacatgtaaattctttagggctatagcagctaaaaagtaaatgaggccgcctcacaccatttgtcatagtttctgctactgaacaaataaatcatcaacaagacaccaagttacagaacagaagtgagctgatttccatcagttgcaaaattctcacttcagaaaatgctagtaaaaggcacaaatttgttgcaaggaaaatcattcggcacttcaaataaaaatataaggccaccttctggcttacctcaggaaaggatgtgagcttgcctatacgggagcaaatccatattttagaaaaacagctcacgagtgtgtcgcttggctgtgtgaaactaatctctttgtcagccccccaactagagtgctacttgtaaaaggtaggctaaaagaagtttgttcaagttgttatacatatttccatggtcatgcaaagcacagtctgcaacttttttcctttgccacacctttctaggagctctgccatgttagcggcagcttaggcagcaaggaaacagattttttttctgctcgtttgcagaggggcagcctgggacagcggtcctcaggcttctattgttgctattgcttggtatttttccattgttttcctggcaggcacacgtaaagacagtgagttagaatttggcccatgagaaatacctcaattaaacccctttaaaaagaaatcactattgtagctgatagccacctctcttccacaggagaaacataatagatgtcaagtgatttcttgtaacaccagcacgttctggataaactttgtggacagcatggccttgtcccacctcccaaatgactgagagttgaaaagcagaaaaacgccagaggctttcgatgcctagcaaaggactcagctggtttgtgctgaggcccactttgcagtggctgatcacagaaaaaaaaaaaatcacttctttcaatctttttacttcaaacttgaattttaaagacattggcatggttttttatttttaaaaacgatattagcctcccaagagcatgacaaattcttggctgtattttctagcacaggtggctctccctttaaataaactcactatatgaaaatctgaattgtacaaaagatagatagagaagggagtggtgatcattcattttataaaaaggattcctttagatggtcagctatccttgtatattttaaaagaactaaaatgtttcatgaatttcctaagtcacccccattattccaggcccagctcaaatcccatattcactaaaaaaaatcatcacaaatacttaacatctcattaactttttttaaacctctgggctcatactcataaccgtaactagaagtgtgctttccattttggggactcaaagaagcatagaatgttgaaacccaaaggactttggagatgctctcattttgcaaatgagaaaacaagtccagggacacttggcaagttagtggcatggccaggactagaactcacatctcttgactctctggctaatgctccattccctgtattgcagatctctgtaatatgagttctcttttccttcataagatttagagacaaagaattgtccacattttcttgatttttcacttaggtttattacgtctgcttttctctttgaccatgactccttaaatgtagaaaggaaggcagtgtggtgtaatggtatgcaacacagcacagtggaaagaggagaggacttggactgggatgtatggcaaatctgggtttaagttctgcctctaccctttagaagctttaacccctcatttgtaaaataaggataataataatcccttttcctaacaattaaatttaattcatgtaaaatgtgcttgagcatgcattttattgactatttctttattgaatgtaataaaagtataaaagtataaaactataaggctggaagaaatcatagggatcacctagttaagcttgcctctctccactcgccattttacagatgagaaacccaagacccaaagaggtgaactgacttgctcaaggtcattcaacttggatactttttcctgcccatgccagatgatttctttactctttttctgtacgtgtttttgtaaattaagtgacattttaacagatagactgaacttaaaactctcccccacccccatgggttatgttatctgaaatcccagtactctgcccagcactctttccattatgctacttcggaacataaacatgactctcttctatgactttaacatttactatttttgccataaatttgatccctgagttggcaatattatagcatccccatcatattctatgtgttttgccttttctcccaaaatagactgcatgtttcttagaataaggtttccttctacttctcctgtatgctgtatgacattgagcaaagtactgggtacagagcaagatctctaaaatcttttgctaatagaagagggtttgactggatcatgggacccagataatcaccttctgtgttccctttggctctcattctgatgtagccactggctatctattcaattgacagagaagtaggttttccccttgaagatcttagtggaatgcctcccagagccatgacaaaggacaatgatactctgaagaaggtgcttaaaatgatgccccttcatgatgtgaaaaaagcaccagtgacacactacagatctactgtctaatgccacgtgtgggagagcacttaatgacccgagggaagggaggaaaaggtgcaagtccaaggttagaagaaaaagaggagtcaatttgaggtcttgtgctcagaacccctctaaacaacatgcatgacatttactagcttaatcagtaggggtttctgtcagcacagttgtgcaagagaaagggtttctcttcagtacagttgttcaaaagaaaaagaatatctcattgacatcagatttattgcctgctagattacctcacaatctttgcaactctattatgaaaaatgataaaaattttacttcattgaaaagtgcaatcatagtattattatttctgttgcaggtagaatggctttgtctagtcatttagattatctacgtataatgcatatccatatacatatatggatattttgattttcatctattttactgtgtatttttatttccacatttcaaatatgtggaagtttccctgctagttcatattgtctttaaacgctttcacaatattggattgttgcactgagtggaatacatccagaccttaagcctttatgaaatgcaaatgatctcagattcattctttttttcacctcaggaaaaagatggggaatgcacttgttccctcccaaatgaagtaatttaatacttgggatccatgaaatgggatttcccaacattaaacactaatgaaaaatacattagtgttcagtgtcagaagctctagaacaccaattctaggggtttgcgagtcacatacactcacttccaaatgtatctggcaaccatacacttctgtgccccagagagaggaagggagaaggggggagtggtgattatgcaaatgtagatatccagacttacttacaaagctttctgaaaataaattaagttttcaaatggaaaggtctaattcacataatatacttggatagtagccagtttcaggtttgaggtcctaaaataacttggtaagataatttctcaggagcaaaattcctccaaactgtagatttgagacattttaagtgtggcagagctactaatagaagtataagccttcagaaacaacattgcctctgtctccaaaaggtaagtgcaagaagaaacgtgtcacgcatagttttttcttttttccttttcttctctttttgccaatacaccttattttggataatgtgttagagaaagctttcacaagaaattagagtatctctgctcagaaatactgtggcaacttatcagagtgtctatcagggtgttttgtcccttacatttcattaacatatacagtcagttctgctacaagacaaagcatgcatttctgcaattcactgcactatgcaaaatcacacctaaccaaagggttatggaaaaaatgaagttagggatgcaacattcagaaacataatcaatgacgcattaaaaaaaaaggaacctaataagaatgacagcatagtttgtcatatattaatggttaagggatacgcgaatgccataccaaatatgacactttatcttgtgaaagtgggtgccagaagagttgcaaattgtgagttattgtgaagtggtgaaaaggaaagttatctgattaggacggaaacttctaaataccagatgtggatgggacaggctcctatccacatgtggtgagctgaaatagctgatggatattgcaggtatatacatgtgcccattttgtgtattcttacgcagttcattctgctgtatgcagttttctgcattcatctagtgcttttaacagatggaattgcgcatatgcaaacgcaaaatttgtcttaagttcaaactgttctcaaacatcccaatggcaaaggaaaaaattaacctttataaaacgagcactgtagcagcactggctgtacatgcaaaataattttcggtaggtgttaaaaataaatattgtcagtattacagtaatgccaaatagacatttttcttgaaaaatttgaccaaagtagatacatggctagcttttctgaaatccatgtactaaattgatcattcttttctttagtgacactgtgacaataccttccctaaatatgttttttcccaaggttactatgcagtgtacgttgtcaaaaggggcacatatattcctatagctctagaaaaaggtcacggagagtcagaaatcatgtctgtacttcctggtcttagtatgtgtttcattatctccttggccaaggggaagggtagctccacaattctttatctacaactatggaatcaaagaatctctgaaaaatgagtttgttttcccctaactcactgggtggcaaaagctgacctgaaatgctttgaggatatttatggtctttacttatttatctaatttcataaattttggtggcaaagcctgacctgaagtgatatgaggacatttatagtcttcatttatttatcttattttgtgaattttcatacatttaggtaagaaagtattaatgcattttattaaggggtgctggcccatacctcactctgggtgagtgtatatataatatacagtatatgtacagcagcacctttgtaaaatttgaaaaattctaaattctgaaaaaagtggaccccaaaggttttggataagggattatgggcctgtattagtatttaaccaccttcctgagctcttatgaggcaatattaattaatgcctctgaagaccatataatctacacgtgcaaagaacatcagggcaccaagagttattgccatactacttatgtcagatctctcaaggccaattagaagtctttggttcctgaggttgcttttctgagctgccctccccttctaggcaggagtagggggtaaaaggaaacaggcttaaaagaaagagaagatattttcttattaatattaactattactactaactcaaaatgtatgttactacttaatggtattttacctgtcacaaagagcttttgtaacttgtgagcaggtagttttaagatttgcatgttacggctaatatccattaacttcatagtgctcaatgatcatcaaattagacttaaatgtatctggctgttctgttctcaacctcgtaattattattagaggctcaaaagaataaaaaggtaagaaaactggttttcagaagaaaataaacaatacagtttatcacttttctggctcaaataatactgctttaatattaatataccaacatcctttattaaaagcagatttatcagttaaataaaccattggattgagaatggaaataaagtccattcgataggtaatgcttaataaatacttatgtataaatgggcatgtgcatgagtgacgcacagacaacaacagaaagagtcagaaggagagagaaatagagaggagatatcacaactgaagcagatgactgaaggagaacagtcacagaggctctgggggaaagctaacaataaattacaatgttttctagtttccatgggctcaacctggttctggattactgcattctgcatggcttccacagccctggatactatttactgtttttcggattgtcaagtacatccctttgaggactttgaatggccctctcactaagccagcaggtaagatatagtatgctgtgttaatttctgtcagttaggttgatctttgttacaatcactggaaatgaaggtcaacaataaagcacctatgatcctttgacatgtttgtgctgaaattcatatttatattttagtctctctataagctgatactcatctttagagggagtgctggtctacatccagaaagtccaaattttctactttctagtttaattaatctcttttcctgttctccaatttgttgtgcaagcatacaagttagtcaaagatccacaaagcagccctcccccagcccatttcttcctgtctctgttatagagggaagccaactgtgctgtacactgtattggttttacatagtacaatcagccaacctcaggcataatactcaatattcctgccaataagtgtctggttttttaactcagtcaaacaatccaggactttacaatcaagaaaaaaagataaggctgtggtaaatgccattttgtttaaattattgtagtaattgctcaaactacctaattttcttggttgtgaaaatacaagatggatataactctgctaatatttgtagagtagtttcgtaatgttaaaaaaaagaaaaatgaagccaatatatttgtcatcttagaaaattgtcatttttctaagtagagtggtaaagagctctactttatggcacaatttggaattttaaatgtcaatatttaaacgttagtatacggtattagttagcaattaaaattagtggttggccaaagccttttcactatagccttgaaagaaactgttatctgttatgtaccatgaaacatgaaatagataattgccctgttttatcttatgttgacaatgatattgtggcttctgttattacccagtgaagtatatcaaaaagaaaatataaaaaagtaatgatcctttaaaatttcatatttagtttatactcaaactaaagtcttatgtaggtatttcaattattttcaatcttcaagttcattatttatttgcaggtaggtaatggagggttatgaattaattgacagtgtatcatttaatgaattagctaataagagatatcctgaacatttataaagttttcattttcagggctttatttttattacactgttataaatggtcaccctgtatttgttcaaaaggcaaagaatgcaaatcgctccaatgttatttataaagatagaacgcaatgtttgaagcacaaatcaggaaaacattacaactgtgtctgaagtttcaagaaaagtatttttcaagctatcatatgttaaatagtgagggcacgctatattaagaataaacaaaaaaagcaaaaggcaaaaattctagagtataaaaaagcatagaggctagggaagcctcggaaaggtttcacccttgtccaaatttttcaaataaaggctgaagaaaatgttctcgtaaccaccgttgtctggttatttggcaagaaagatcccctgtactccatagttcctctccaccagcacaactttaagaacaaagggcactcatggacacctaatggagtgatggagaggaaccctggcatctataattgggagctaaacaagtacatagccctcatctgggacaatgggaagagatgtcactattatagcagtattcacaagagccagaggattctcaaatttcactcatgttttggccctttgctccagttcagcaatgctcagatataggatcaaaacatgccaatgttttgcggtcacctgttgctataatagagggctgaaattcacaaatgatttatttttaaaaagtatagatgagtggactcagggtgatgcctctaatagtgccactctcactgagttgcatttggatgtgctttcttggatgggagagaaaggggttggggttatagctagtgataggaattgggtacaactctgatcttataagcaattgtaataagtgattttcatatccatatgcttgtaaagtgattctactcataccatgggagggacgaagacttgcttatctttcccctctgaacgacaacaacaaaaaggaaataggaagcattaaaaaaaggagtcctggtattctcatatgagtaacatgtacatgttattcaaatatgtcggggccaaaacatttttttttcagaattatgatcttaatgattgctggtagaacactactggctgccaccaatctttctgtctgacatctaatgggctagtgagggagcctcctaagaagtatgagcaggaaagtaacaattctgtaggaaggacagagaaagttttatttcccctcttgcattcaagctatgcatatacttgtcttgtatcaggatgtgagtctgaatcatctttatatctcccacatacaacccataattttattcaagtttattattttgtttatttacaaatttaattaatttgagtgaattcaaaaatttaaagtttgaattcaatcaagttttattttataaaaaagttatagcaaccatggtgggtgagagtgttttatgatgccaaataacttatttgattgaattattcacattcctaacagctgttttggcattgtgtgggcacagcctgtatctgaaaagttttctgcttgaaatgttcattgattgattcattattacaaattttcatcttcttgtttttcaacatggcattttagtgaaatgttaaatagagctattttttgggagatatgccaaaattacaacctattactaagcctatcttataaactttgcttatgctaagctatgcatatttaagtcattttatttttccttcaaagtctgattcattctctcaattacattactgcttatctccccggactcactccaatttaactaggtctttatggttccccaaacaaaatgcaacattctggatgaacatcacccagaatacaaaaaagttatctgataaattcttttgtaatgatgtcttttcacatgtagcctcaaactatgtgtagattgcacttgagacttcattaactagaatatggctaatgaagttgtgagaaggcagctcaattaggaaatatactgatctattgatatagatgtgtctgctagtggatcaagtgaaatgtctatcaagcaaattaggccaggggtagtggctcaggcctgtaatcccagcactttaagaggctgaggcaggtggatcacctgaggtcaggagttcaagaccagcctgccaacatagtgaaaccaaactactaaattatgaaatttattaattttgtacaaaaaaatacaaaattagctggacatagtggcacgttcctgtagtcctagctactcgggaggctgaggcaggagaatcgcttgaacctaggaggcagaggttgcagacagctgagatcacaccactgcactccagcctgggcgacacagcaagactatttcaataaataaataaataaataaataaataaataaaattaaaaaaaataaaaacgcaaattagtggaatctgctcatatgatattagaatgaattgaacaacagtgaatgcaggtactcccctccagcgaaatgaacataatgtatagatgccttcagaaaatgaaaaaaattagctcatctcaaggggaagagagtcagcttgcataaacagaagaaaaaaatgagaacacatgttaatgaagctgtgaatatgagactgcagtagtaaatatagatggaaatcctagaaattaagaaatgatttcataggtagtgattgataaatatgtcctttaagcaagtattgggttggtgcaaaagtaattgcggttttgccatggaaagtgatggcaaaaacctcaattacttttgcaccaacctatctcttaagcaatttagttcttcgttaagctcattcaagtaagtttttcaaaaggtactcatgtaccttgtgaaaatacatatgtatgataggtgagatgctgagagggacagtagattaaacatacattacttatgtgaaacagtttctcagagagacttcttgtagtgcctgaagtcagtgaatgaatgcacagacgctcctttctgtgtattaacactggaggtctggaccagagcagaccacagagtgtgatctgggttcctggatgggaatgatgacaacctggatttgattcaagtttgcttttacttttcttgactcccaaatagcaaacacgtaccacaaaggatagaaatgaaattaaaatgcaagcatgtatacatggttcccttttgcttcccctgtacttcatggagacaagccctcattttctggttttggtagcccacacagagtgagctgtctccccctcagggtaaaagaacatactactatggaattgctctgttttatgctcctggtctcatcagcatttggaaactgcttatgtaaagcataattccattactcaggaagccattgtcacttaggcttactgaccagctacctgatcttcaaattcttgccctggcagcactagggcaatttcctcttttccatacttacagtacaggacttagatgtttcccattctgggtagttttgaacattgtgtatcatagggctttctagtgataaacatacaaaatgggttgcatgtcaaggtatacagatatatatatagagagagagattatatatatatatatttaaattttattgttatgtgtacagaataaaaggtcaagtgctgtctactactgaactatactcttctttaaagtagggcttatcctacttataacttacaaaataaatgatgaggaagccaaagaaaaggagaaattaacctaaacgtttagggaacaccttatatttagtagtagaagacaaagaggagagtgtcttagtttcatttgtttgttttcaataaggtgaatcaagtgtagagtactttctctgctactaatttacttacttagagatatcatctgtatataacttgtttaaattagtaagtacatcataacattttcgaatgacacaatggttaagttacagatattagaatcagacctatgtcggtttaaatcacagctctgtcatttactatcagtttgctataaaccttttcaagcctttgtttcttcatctgtaaaataaggatagtaataagcatctcaatgttttttgtaagaaataaatgaggtaatgtgtacaaaacacttagcagagtgcttggcacatagtaagcactaaataatattattaaatgaatgatcaattattgagctcaatgaaatctataaaatcaggtgccatctagtaagtagcctaagaggataatctacttgactccaagacacttgattacttaaaacttctgcattatagttgattttttttcacaattttcagttttcttattttcttctaaaagttctaagaagctattattgaagtcatgagtcaatataagaacagttgacacctttcttttcctcttcctccaagccacaccaaacactctctattgatcagcttctttattatgctgcaagtttctttcacttcagataatagtctctatttcatgatttttagttaagtactctgactgtgttcacttgcattttcctctatactaaaatgatctgggggtatacatgcatttctaaagtatccattgcaataacaccttgagactcagacattagagcaaaggatgtgaagaagagccatttccatgaatacaacattagtgctttgtatttatgaagcacctttcatctgcatctttcaaagactttcacaaatattatctgatgctttattcactgggccaagctgcaagcaaaactggctttcaaataattccctcacagtacgtcaaaccccatgagggaaggagttgtggataaccgtttgaagtgtcaggaatgctcagaaacatttttaaatagtatatacaaaaataccacctaacaaacgatgacgactatttagaaatgtggcgctttgtaggtataccgctcatagcaaataaacaggaactttatcatattggcattaagaccaacatccacattataaatgaaagctatctgctcaattttgtaactgtgtatcaacctaatttgggacatacgacttgcctcatagtgtatccaaatatattcattaaagcattgcatattaattatagtatatgtaaacagcatgggtaccagaccaggattgtatgtcaaatacttagcatagtgcctggtacatgtgacacattcagttaatgttagttactaatataattattattgtaattatttccagtatgaatttagattatgaaaccaattttctttcaaagaattcagtgatgacttacatatattcacatttgttgctgttgctgctactgctacaactattacttcttttccttatgcctgttaggatatatacttgcaaagtaggaagaaaagaaaaacatgtccccttcctctgttggaacagtagaccaagatggggagaggtaaggctacacagatgttaaggcctcttcccaccttccaactgaaaccatttacacagagtcttgttgtcatgaagactatggctgtgggtattccattaaaacgagtggctaatcatttctggggggaagacagaatcaaattagagactttttataacccaaatgaaataagtgacctacaaagttttagtaaattttattggtgccatgaaaaaaataacatgaatttagacacactgactgtggagatatcacaagtttcatttacttctttttagtgtttttatttttggccctctagtctctcttattttacattcttgttcacataactggtatgctgtgaaaatggactgtttgaaaaaaagagtcattattgttaagaatgtgtaatttttaaagttttctgaggctataaataacttccacagccttgaagaaaacacagtgtttcaacattcatatgctgtgcccattttagagatggagaatatgagtctgagagatgtggagaacttagtgcaaggccttgggtaccatagtattgcactgattccatttgttgccactcagccatctctcctggccttcaaaacaaacaacaccaactgtgcttataccaatcttgtcattcctctttattgcaaacaattaatataaaatgctgagtctgaacagctatgtaataacttataatgaaatctatgtagtgggttattttatttgtaagtccgattcaatatgctcaagcacacatcattaaatgtttccttttaattttgagtagcaaatatcttcatttcagtagcacctacataatttatgtaatctatagtaacagttgttagcttatttggtgtgtcattttatcccaagttgatgctgaaaatatcagaagaggctgcttgatgggcttgctttaaaaagacaactgagcaatttatgtatgctgtttttcttcctgcacattaaagtttaaccacatttacaaatgaaatattatgtacctaaaaaaaattcttatttaatacaataactggcattcatgatgaccatctctctactatgggaaataccaaattggcttcaagtaaatgttattacaataaaaagaattatcttaaactatgagtcacatgtagggattttccttctctaaatacatgttagattacaacaatagataattatgaggatagtttagggttatggtaattcaactagaaactctagaaatagtatcactacatatgtcactcagtataatagttcttttttcattttattttattattattatactttaagttttagggtacatgtgcacaatgtgcaggttagttacatatgtatatatgtgccatgctggtgcgctgcacccactaactcgtcatttagcattaggtttatctcctaatgctatccctcccccctccccccaccccacaacagttcccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccacggtgaatatgtgccacatttacttaatccagtctatcattgttggacatttgggttggttccaagtctttgctattgttaatagtgccgcaataaacatacgtgtgcatgtgtctttatagcggcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccaacacctgttgtttcctgactttttagtgattgccattctaactggtgtgagatggtatctcattgtggttttgatttgcatttctctgatagccagtgatggtgagcattttttcatgtgtcttttggctgcataaatgtcttcttttgagaagtgtctgttcatgtccttcgcccactttttgatggggctgtttgtttttttcttgtaaatttgtttgagtacattgtagattctgtgtattagccctttgtcagatgagtaggttgtgaaaattttctcccattttgtaggttgcctgttcactctgctggtagtttcttttgctgtgcagaagctctttagtttaatgagatcccatttgtcaattttggctttcgttgccattgcttttggtgttttagacatgaagtccttgctcatgcctatgtcctgaatggtaatgcctagattttcttctagggtttttatggttttaggtctaacgtttaagtctttaatccaccttgaattaatttttgtataatatgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaacgttagttttttccaattgtgtgaagaaagtcattggtagcttgatggggatggcattgaatctataaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaatttggattcctaggtattttattctttttgaagcagttgtgaatgggagttcactcatgatttggctctctgtttgtctgttactggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccattaatacctaatttattgagaatttttagcatgaagggttgttgaattttgtcaaacgccttttctgcatttattgagataatcatgtgatttttgtctttggttctgtttatatgctggattacatttattgatttgcgtctatcgaaccagccttgcatcccagggatgaagcccacttgatcatggtggataagctttttgatgtgctgctggattcaatttgccagtattttattgaggatttttgcatcaatattcatcaaggatattggtctaaaattctcttttttggttgtgtctctgccaggctttggtatcaggatgatactggcctcataaatgagttagggaggattccctctttttctattgattggaatagtttcagaaggaatggtaccagttcctccttgtacctctggtagaattcggctgtgaatccatctggtcctggactcttttcgttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgacatcccctttaccattttttattgcgtctatttgattcttctctcttttcttctttattagtcttgctagcggtctatcaattttgttgatcctatcaaaacaccagctcctggattcattaactttttgaagggttttttgtgtctctatttccttcagttctgctctgattttagttatttcttgccttctgctagcttttgaatgtgtttgctcttgcttttctagttcttttaattgtgatgttagggtgtcagtttttgatcttttctgctttctcttgtgggcatttagtgctataaatttccgtctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcattgtggtctgagaaacagtttgttatagtttctgttcttttacatttgctgaggagagctttacttccaactatgtggtcaattttggaataggtgtggtgtggtgctgaacaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctgtgtaggtcactcaggacttgctttatgaatctgggtgctcctgtattgggtgcatatatatttaggatagtcagcccttcttgttgaattgatccctttaccattatgtaatggccttctttgtctcttttgatctttgttggtttaaagtctgttttatcagagactaggatggcaatcccggcctttttttgttttccatttgcttggtagatcttcctccatccttttattttcaggctatgtgtgtctctgcctgtgagatgggtttcctgaatacagcacactgatgggtcttgactctttatccaatttgccagtctgtgtcttttagttggagcatttagtccatttacatttaaagttaatattgttatgtgtgaatttgatcctgtcattatgatgttagctggtgattttgctcgttagttgatgcagtttcttcctagcctcgatggtctttacaatttggcatgattttgcagtggctggtactggttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggctcccgctctcttctggcttgtagagtttctgccgagagatctgctgttagtctgatgggcttccctttgtgggtaacccgacctttctctctggctgcccttaacattttttccttcatttcaactttggtgaatctgacgattatgtgtcttggagttgctcttctcgaggagtatctttgtgccattctctgtatttcctgaatctgaatgttggcctgccttgctagatttgggaagttctcctggataatatcctgcagagcattttccaacttggttccattctccccgtcactttcaggtacaccaatcagacgtagatttggtcttttcacatagtcccatatttcttggaggctttgttcgtttctttttattttttttttctctaaacttcccttctcgcttcatttcattcatttcatcttccatcactgataccctttattccagttgatcgcatcggctcctgaggcttctgcattcttcacgtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcgtcaaagtcattctccatccagctttgttccgttgctggtgaggaactgcgttcctttggaggaggagaggcgctctgctttttagagtttccagtttttctgttctgtttttaccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcagtggctgcagaacagtggatttacgtgaaccgcgaatgctgctgtctgaaggttcctctggaagttttgtctcagaggagtacccggccgtgtgaggtgtcagtgtgcccctactggggggtgcctcccagttaggctgctcgggggtcaggggtcagggacccacttgaggaggcagtctgcccgttctcagatctccagctgcgtgctgggagaaccactggtctcttcaaagctgtcagacagggacatttaagtctgcagaggttactgctgtctttttgtttgtctgtgtcctgcccccagaggtggagcctacagaggcaggcaggcctccttgagctgtggttggctccacccagttcgagcttccggcctgctttgtttacctaagcaagcctgggcaatggcaggcgcccctcccccagcctcgctgccaccttgcagtttgatctcagactgctgtgctagcaatcagcgagactccgtgggcgtaggaccctccaagccaggtgcgggatataatctcctggtgcgccgttttttaagcccatcagaaaagcgcagtattggggtggaagtgacccgattttccaggtgccgtctatcacccctttctttgactaggaaagggaactccctgaccccttgcgcttcccgagtgaggcaatgcctcgccgtgcttcggctcgcacacggtgcactgcacccactgtcctgcacccactgtctggcattccccagtgagatgaacccggtacctctgatggaaatgcagaaatcagccgtcttctgcgtcgctcacgctgggagctgtagactggagatgttcctattcggccatctttgtcactcagtataatagttctaatggttggctgtattaaataaatacatagtgtagcacttcataggtatgccaaaatctagtcttaaaattcgagggatactagagagctgtcttgttaaaaaatgtgaattgaatgttattttatattttatggatttggggaacttcttacacgtaaattattgtattcttcataatgtaacatactaatacactcaatttgtataacatctccatttgaaagaactgaaaatgtaagacaaacaaacaaaagcattcgaattccctaaacattttaacagaagtttgtttatacgggagtataatgagtagaagtatctgaacaacagaatttttttgaaaaagggctttaaaaatgattgttcattttgtgcagcaaaggaaacaatcaaaagagtgaaaagacaacctatgaaatgggagaaaatatttgcaaaccatacagctgagaagagattaacatccagaatagaaaaggaactcatacaattcaatagcagaaaaaacaaaacaaaacaaaacaaaacaaacagaaaaactaaacaacttgattaaaaaatgggcaaaggacttgaatagatatctttctaaagaagacatgcaaatggacagaaggtatatgaaaagatactcaatgtcactaatcatcagcgtaatgcaaatcaaaaccaccaggagatattatcttatacccattaggatggccagtataaagaaaaatggaaaataaagtgttggtgaggatgtggagaaattggaatctttgtgcactgtcggtgggaatgtaaaaaggtgcagcttctatggaaaaaagtatgaaggtttttgaaaaaattaaaaatagaattaccatttgatccagcaaccctattaaagagaatatatccaaaagagtggaaaacaggatcttaaagagctatttgcattctcacgtccattgtattactcaggacagccaagaggtggaagaaatctaaacgtccatcaagggaggaacggataaagaaggtgtggcatatacatatgattgaatattattcagccttaaaaaaggagatcctgtcatttgcacaaaatgatgaatctggaagacattatgctaagtggataagtcagacacagaaggacaaatactacataataccacttatatgaggaatctaaatctaaaatagtcaaactcttagaaagtactaatagtgatttccaggagttgagaggagggggaagagggaagttgtttaatgggtataaatttttgattttgcaagatgaaaaggttccagatatttgctatacaaaaatgtacacatagttaacactactgtaccatacacttaaaattggagatggtatattaaaattaagatggtatattttatgtgtttttatcaaaataaaaagtcatgccatttcttcattgaatggaatatttatctataaataattgaataaataattcaatcttttattttacttaaatcacatggcgatagtgtgattctgtgggtcagcaatatcacagtggacaaatgaaagcgttatgaatagggcagacaagttataatggataattacatggtcatcaacacagattttgctggtaacccaagaattgtagtgttcttaataacgtatgttttaatagatagaaatagttttttaaaaaaaaaattatttccataagcttttggggaacgggtggtatttggttacataagttctttagtgttgatttgtgagattttggtgcacccatcactcaagtagtatacactgaacccaatttgtagtctttcatccctcaccccctcctgctctttttcctgagtccccaaagtccactgtatcattcttatgtctttgcatcctcatagattagctcccagttatgagtgagaatatacgatgtttggttttccattcctgagatacttcacttagaataatagtctccagttccattttaatgcactgaattgtgtacatatatatcatacagcctattccttaatgtaaataatcagttgtatttggaaaatttgggctgtgtcaagtaatgataaaagtaaaagatatgtgcttgctagccaacaaaacctggagatatacatccatatttctaaataaataaaataataaatagccgattatcttggtttaggttgccataacaatacgccattgactgggtggctaaaacaatagaaacttattttctcacagctcagagactagaagttcaaagtaccagtgatagagacaggtgacagtcaagagtccccggcaaaaccctgctttcaagcctataatagcctgaaggctgaaaaaccagactgctggtcccggatgaagcccaccctttcacgactaattgtctctgaatacagcccacctgtgcactgggaggaaggggtggagcctcaggaagttctccccatttgcagtggggaggagcccaacctctcctgttcctgtgtggtgacctgggattcaatctgtgaagtggagggcctgttagcatctcactttgctgagttttttttcctttttgcccagtaaattccactcctcacccttctatgtgtccgcaagcctcatctttcctggtcgtgtgacaagaacctgattttagctgaactaaagagaatgttctgcaacaccagtatggttggtttccggtgacggctctattcctagcttgaagatagctgctttaagagagctgcttcctcttttcctaattgaatcccctttatttctttcttttgcatgattgccctggtgagaacttccaacactatgttgaataggagtggtgcgagagggcatccccgtcttgtgccagttttcaaagggaattacactttatacaaaaattaattcaagatggattaaagacttaaatgttagacctaaaaccaaagaaaaccctagaagaaaacctaggcaataccattcaggacataggcatgggcaaggacttcatgactaaaacacaaaaagcaatggcaacaaaagccaaaatagacaaatgggatctaattaaaccaaagagcatctgcacagcaaaagaaactaccatcagagtgaacaggcaacctacagaataggagaaaatttttgcaatctacacatctgacagagggctaatatccagaatctacagagaacttaaacaaatttacaagaaaaaaatcaaacaaccccatcaaaaagtgcgcaaaggatatgaacagacacttcaaaagaagacattaatgcagccaatagacacatgaaaaaatgctcgtcatcactggtcatcggagaaatgcaactcaaaaccacaatgagataccatttcacaccagttagaatggcgatcattaaaaagtcaggaaacaacaggtgctggagaggatgtggagaaataggaatgctttttcactgttggtgggagggtaaactagttcaaccattgtggaaaactgtggcgattcctcaaggatctagaattggaaataccatttgacccagccatcccattactgggtatatacccaaaggattacaaatcatgctattataaagacacatgcacacgtatgttcacggcggcactattcacaatagcaaagacttggagccaacccaaatgtccatcaatgatagactggattaagaaaatgtggcacatatacaccatggaatattatgtggccataaaaaaggatgagttcatgtcctttgtagggacatggatgaagctggaaaccatcattctcagcaaactatctcaagggcagaaaatcaaacactgcatgttctcactcataggtgggaattgaacgacgagaacaattggacacagagcggggaacatcacacactggggcctgttgtggggtggggggaggggggagggatagcattaggagaaatacctaatgtaaatgacgagttaatgcgtgcagcaaaccaacatggcacatgtatacatatgtaacaaacctgcatgttgtgcacacgtaccctagaacttaaagtataaataaaaaaataaaaaaacatgaatgggatcatactatttccattgttttgtagcatgtttttctaagaaatgcatttggagatctttccacgtatgtacatacaaatagaccttaatttaaaaaataatgcttccatagtattctataatataaatggattataattttaaacaactttttgtgggtattctgattacaagtgaagtggagcatcttaaaaacagtttgttagccatttaaattttattttttcatttttaaaactgaatcgcctctttataacttctgtccattttaatgtacattggatgtttggtcttttacaattgatttgaaattattacataaagcccaatatcaatccttttgtgttaaatacattgcaaatattttcttccatgaaaaataaaaagatagctgcttcctcgttgtgttctcacatggtggggagaaagtatgtctcttcttagaagggcactaatcccatcatgtgggccctatcttcatggaatgatctaaacctaatcatcccccaaaggcccaattgctaaatactatcacattggtggttagggctacaacatataaatttgggggacacaattccatacatagcaccaactcatctagataatgtattaacactaaataaatgttttcttcaactcatgttttaaaaacttgtttattttctaccatatcttacattccatattatgtgtcatgctttctaagacagatggttttaaaacttatttcttactatactttgcatcttacactatatagcataaattgattagctaacatgcctttaaaattgttatgctcacttggaactaggatatctaaattccaatataatagaacaggtcaggtctcagacattctgagtaaatgatttgttactgtatttaatcattttcagctctcttatacacagagaggtgcaaatagcattccatttatatatcattccaatcatcattctcattataagatgtggtaagttattgtgattataaagttgctggtacaataaatacttacctttaaatataaggtaaggaaaatgaggcatggaaaatttatgttatttgttgaagattacatggtcaaccagtggtgaccattgagatgagtatgcctttactccaggtcataatcactttccagctttacacataatggtcagcatcatacttgtgtatgatgctgtagtctttactgtgtagtctttacttgtgtagtctttactgactaacctcattccaaagattacagaaataaatctgccatttaacccttcttcctcttcccctaacagatatatctgcctgaaaaatcaccaaaaggaatagtggatggtcatcagaaaaggttatgtaactgacatgggaggagggtaagcacatgcatattaatacaatggaatgatgagcaggtaattgtaaacagtggtagagttgaaaaagagagaacagactagtctacaaggtttcacagaaaagttgtatgatacacagggaagggaaatggccctaatgaaagggagcagggtgcctcagtggcttgggcaatggtacgagggaatggcagagcagcagaagtaaatataacaattaagagaggggaaaaattatagacatgctaatgctgatttaataattttcctagcccaagccagctatttaattttctaaacaaacatttttgtactgcttattaagtgttaggtatgctatgtgcccaagtataatggtgaaggtgaaagtcacttctctcaaaagcgcacacacacacacacacacccctttgaaaagcttagtcagtgagaagaaatggtgagacatgaggttctttgtgtctccaggagctcatctcctattctcagctgagttgcaactactaaatgtcgcattaatccattaataatcactccacaaatattctaggtttcatgtgagaacaggtctctattgtagagccatttatatgtgtgctttacaaggtgatcagtgctatgtcagtagctgaatcaggtaataggcacagagatatctctcagatttaggattaagttggaatgttcaccctagatatagtcttctatttctggagggcattccaaagaagcaaaatatacctttctatcccagaacagactagactttgttgaatcctattgtaaccgtgtcaccttggattagttaccttctatgtcctggagaattagcaagggaaaaactgttgctggtacatcttgattatttaacatataatggttatttgcagggtttggctaaacttgaatccaacgtttataaagaaatttatgtttaaagcccttattcatgttactttatcaaaggcaatcaaattttatcagtgatcattgcttgctcttctgccttctattaagacctcaggtcctcaaaggacaatattttccagtgacaaataagtttgcctccctggagaggagagcatgactaggtagaagtggtaaatggacatagtcaaatgagtgcaggcgtggggacagcaattggtagatggtctttaaacccaagaccagatatttcaattagagaaccaattaggtacctttttatgttgctgtgaagcttagagcacactgaggagaaaggaatctgaataggtaagcaaggaagccaatgagggagattgggtggtaatatctgggtatagtgtttagggagtgtgaaagtacttagtgacagctgtataaaaatacctgcttctgctacatttatgtttgtgtttgggcttgtctgtcttgtccctcaactaaatggcaaattctaagaacagggagtttcttattttatcaatccacacactgcctagtgccatgcctcactagataagcttgtcaatggagtgacaaatgtgttccagtttctgcaaaataaactgaagcaaaggccaatggaagacatttttgaggtatgctttgtttggactgttttttttttttttttacattggaaaactattggacatttaaaaaatacgtacacatgtagattgactatattacatttaaattcaaaagttttagaacactttttgaggggttaaaaaggtatgattttggcccagtatacctttgcatatttcctgtcctgcagccacactgcaacatttgccattcaacagacccactggtgctctctccatctctgaatctttgcattcatacttgacttcccaccttgaatgtcctttcatcccatattgtttgcatcctactcttctgaggcccattaccaatgttaccccttttattaaccattctttgaaatctaaagaaagaagctacagtaatctcttctgaccacctatagcactgtttcctattatgcccccaatacctcctaagacacatgaagccaggtggtggcagaaagagaacagacagatatagaaaaaagcagacaggaggcagttactgtgtcaggaatagcagaaccctggattgaaaattcacaaactcctgctgctgaaatttctagagcttggttcattttcagattttggacatgcacgcttataataaatccttatcatctgagctagtctgagtaagtctctgcttcgtgcaatcgtccaacaggcctaatgttgtgctttgtatttgtatacttgttttatcttccctaacagaggataaagccctttgaaaggtaatgactctcatagcacctgcagtgtggtacacagccagtacttagcaaatgtttgttgaaaaactgaatggagaaaaccagacaagtcatcctcaaatcatattgaatttccatccatttttagcaaggcaagaactgaacataggtagttcataataatattttactaaacaatgctttttcaaatgaatgatttgcctgcttccctcttcactgttatagatttcttcctattagtgttctgcaaatgcgtttatgacacgtctttgccaaaggctaacttcagcagcagcaccatgtatcaaaaaagatgtgtcacatatgcaaattacataatataaagccatgcattcctctcattgttttaactatcttttagtttaaagggtgctggtctgtttcacatttctttcagagaggccaaaaacatacactctacttgaacttatgtcatttactcataacgagaaacactttgtcaaccttattttcacatacatctggtgtgactagataccgtcacggaaattatttttaacagtgaatttgaaggattaaaaggttcacgaaagtcacatgaaatacataactatgaagtatagtctcattttatggatatcacctccttacacttatatagtgttttatggtttgcaaaacactatattatctcatttgctccttacaacaggagtctgtgagatagacatggaaggcatcattcccattttatatatcaaaaaccagaggagttaactgactttactaaggccatagagattgtaagcagtaaaaagaacccagaaaaagaacccaagtctttcaacttccaatccagtatcttttgacttcaaatccagttattttcaactattctatttataacaatgttttccaaatgtctggctatgatcaattgatgggttatgaaaccaattttgactaggataaaaaatgaaatagaatataatatatcctagaacatcacatttagtaaagattttaattgtttcatgaaacttttgtttcagttttgtatattatgatgcaaaatatattttaactgtgggaaacggtgagaaaaataaattaaaagtcactgttctataccatgttgcctattaaactaattaagtagttcaagagtactttgtgccaccaaaatgtccacattattggttttaacattaaaataattgtagataataaaaatatggtttctggcaatccttgagttaggtattgtttatgtgccggtaatttcattgcttgagtgcttttaagagttctactggaatattatataaaaatttgggtttttatacaggtatgatggtggttttattactgcttttgtggaaaaaaatgctaattgtgctttataaagaaatcatcttagaaaatcttcacctgacttaaatatattcaggagaatgtaggaaacactgactatagataataccctggtattcacagatctaattcttattaaattaggatatctgatatctctgtaacttattaacagcttatttaattatatgtattaccaatgaataatcaaaatgaataaatccacaactgttttcttaattacaatgaatacaatggctcttcattatatgtaacatatagtacaaaatcattagtagggcctataaaccccagcagctttatcccctatctctctactctgcataagccacgcacatctgtgtttccacagtactgtattatacatgcttcctttgctttgatgctattgcttctcacccttctcagtggagctaggtcttaaggcatgaatggaagtcttttaggcaatgttacctcttctgtgatgctttcttccattttcctttctgtgttctcacacaacttattatctatcagaaaccaacattatcatgagtatttgtgtgtgtgtgtgttgtgtcagtgaggcagtgagttgcttgaaggtgaggtctatttattattcatttttgaatcttggtgccctgcacaatgtctaggtcatagtaggtacctgattaaatatgtgagcaaatagtattaatatttaccttgaatttacttgggcaaatgcaaaaatacataatgcaattttacatgtggtcataagaatttttagatagatctatcaatctatctattcttttttacaccgaaggctttattgttctttactgaatgattacatattaaaatattaatttaggggcagaaaattatgcttaaacttattattctgtggttcatacaatagcaaaggagctggctgatttggtctgttcaagccaacacttaaccaaattgctgacatgattttattcgacgacgtgcataatatggaccaaggcatttttattttcccacaggctgagatggtggtttagagatatagcctaaatgttagaattttctctctataatttagtcatcattgtactatgaaaaaaacctaaaagataagcaaatttttatggatagttgggtcatttaatattttctgatatggtgctattaaaatttcatttatattcctatagggttttctcctcagtgtttcagctaatagactttgaagtcccaatgtgtctatctctcctctgagggattttaaaaattgttgctctgaaaacagagcactaactttcccaacagataaaacacacgaaccacagctggagaagtgtgaacgtcaatttatccttcatagcacataaaattagactctatgattgtagaggaaggcaatacttaattgaaagatattttaatacataaacatattagaaaaccatctgtctgaggactctactgttgtgtatctatgctacaaagtatttttaaaaatatggtaggctaaaggataatcctaattcacatgtgagtttgggagataagtattttttattttcctggcttgaattctttatacatttctcccatgtatgtgattgcttacatgtctaaccttcagctaaataataagcttcagatggtatccaaatctttctcatctccagattcccagagtggtcaacaccatgttggcacattataagtgtttagcaaatgtttactgagaaaataaatgacttattattaaaaccctgatgctttcaacattttccctaggagccatttgatattttcctttgtgttacaatgttacaaagatgaaaaccccacaatttctttctttgcctgttcaaagatgtggcagtaatgatagaggaagaagttggattattcataacatacaagataatctttcacggcaatctaattctttggcttccatgtgcaaaacatctgaaccaatggtgaaaaatgcaaataatagaatttgtatcttcaactaaaaatcaaactgctgaatagcaggaaacatctgggtgattaatccattcacatattcagtattgaacactcagagagttgcaagaatctaaatgttgtccattgcttttggattacttgtagaaatcacaattggctttcctgtgttttatttaaagttcagtgtaactgaggattcattatgattttgtattttgagatattagcaggtcatattgtacatttttcttattccctttttcaaaacctgtattctaggttattaaagtgcttttaaaataacatttttagaaaatagaaattacacctatctaatgttaaatacaattattattataacaaatgtaagaaaatattcagggaaacatactttgtcatctgattccaaccaacaaaatatttttaatgagtgcatgtctattaaaagaatcctcaagatgctataattattattcattttctagaattgtttcaccatgaagctttatgcttctatggggactttaatgtttatgttttgtgatggctacattgactattaaaaagcaatttggctgacattttaggtcttttgttgccagttttaattggattgttcatcaagcatcaactcccccgttaactgcaaaaatttcaggccaacgtcagtttacagtaatgactgtttaatgattttatcctgtcagtatacaagcttcgtatggatatatgcatgattagtttcatatcaagacctgtaattaaataattgaagcctaaacagaatggatatcaaacatgaacacatatttaataaagactcagaagcttatcaaaatactgattagcaattaaaagtcaatgttttgagttcatctggtgtcagtacatttatgatactttagtaaatatttgtatgaagattttgcgtaaagttaaaagacagaaattctttttggaaaagcagcaaaattgctttttaaaaaggtaatttatatccaatgtgtatctatctgactgagtgagaaaactcattttaagtattatttcatctggagaaaaaattagccaaagcagaagaactctagagtaccaataaatattcttatcaatcagacacaattccaatccttaaaaagttgacctatgtacacctaaactaagctgtcacctgtttgcatgttagaatgaaaggactgaggagggccttggaaactatttattctaacttacttattttacagatatcgaagtccagatgagtaaagtgacttgcctaacatcatatagctaattagtggcagagtcaagacaaaaaatccaggtccaacattttaacttatatattcctggaagaaagcagtttaaaacatcttttgtgtattggtaaatttattttcttcccatttcattacattaacatgctttgtaacaaaacaagctaagaaacaaattgtttaaagaggtgtacagtaagtttcactttgtcttttctccccacccacttcatttctcctccaccccctgtaaccatttttactagcttcttattcatctttccattatatttcacaccagtacagaatatcagaatatatattataatatcactctttctgtacacaaagcatagtatattatatttacatttttacaccttacttatttttgagatagggtcttgctctgttgtacaggctggaatgcagtggtgcaacctcagctcactgcaacttcgacttcctgggctcaagtgatcctcctacctcagcctcccgagtagctggtaccacaggtgtgcaccatcacacccagctaaatttcttagttttttttgtagagacagggtttggctgtgttgctcaggctggtctcaaactcctaggctcaagcaatcctcccacctgggcctcccaaagtgctgggattacaggcgtgaaccactgcacccagaccatttttttttttttttacttgacaatacatcttgagatctctccataccagtgtatagaaatctttcttgcgttctttttctttaagcctgcatagtattcccttcatggatcttatagtttattcaatgtgttggcaaattattgatcattatttgaaaatgttttatatgctaaaaattatttcacctacatataggaagtacatatttgcataactgaaacttagaaaatgtagatactgatataaaggctgaactccaatacaccgtgcacagcactaaggaactagaaaaaccattactttttctttgatttaaaattctagttctatatgtatagttattatttatcaattataaataaaaattaatttaaaagatcataaaaataaagttctagttctaaagcctgttgaataagatgtttttcagcatttactggcatgggtgagtgaaacaatgtgttattaattaaaatgtttacaatgtagcacacagaacttttaaattttaagctatgttcagtaagcacaacatttcaaaactctcccaccttcagtcccatagatcatactactttctttctgttcatggtaacccatatatagtcttcaatttaaaatagtttcattaaacattaaaatggaaggccagcctatgctgctatagtatagtgaaagacattagggagacagaccaattaaggtagaagcagatttcttgttaaatgacagatcccagattcccatttcatgaaacatgtattcctgccacatgccaaattcccattaacttcaagaaggaattatgcacagaaatacgtaagctgaagaaggcaggatgaattagtccagcgcaatccttaaatgtcagtttaaaatgcactggatgctttaaattatgtgtagtcatgttgtttgaattgaatattatccactcacacctactctctgatcacatcttcaaaatgaatggggcaaagaattgcttggaatagagaagagacatgaacagctcgatttggaattgtaagaaaagataaaattcaaaggtgtgagtcatgaaaatgtaatgattcctcaagaaaacagcttaagagaaagaaactactttccctcagcatataaaatatttacatttaagaaaatgtgtagaaagatgttaaaaatcctattaattcaggccagttggagagtcaagttgtattaagtgttaagtccatataatatttaaaatataaatgtgtgatagttactttcaaatgcactgtatgaatgttagtcactacttactagtatcctatagaagtttctagactcactggtttaaagaaaaacaataaaaatcttcattgtactactattgcttttaaagttcttaaaatagtttattctcttaggcaggtgaaccaaatcccctatattctttctttttttttttcttgagacagaggcttgctttgtcgcccagactggagtgcagtggcaccatctcagctcactgcaacctctgccttccgggttcaaacaattcttgtgcctcagcctcctgagtagctgggactacacgcacacgccaccacacccggataatttttgtatttttggtagagacagggtttcgccatgttggccaggctggccttgaactcctgacgtcaagtgatctgccctccttggcttcgaaagtgctgggataacaagcgtgagccaccgttccctgtccccctacattctttatactactctttccatggaatattccggggtaagattcaactagtactgtcaaaagtttttaaaattatgagacttttctatattaaatgaataaaaaatttgccccttaaatggcatataaaaagtgtaaacattttttaaaaatatggtctttaaaatagaatagatacttggtaaataataatctgaaatcatctcggtaaaaactctaaaataatattgtatactacaaatttttttctgtgccataaaagaagattttcattaaaaagctgatgttgaaagggctgatatgtcatactttgtcaattatgccaaaaaatgaaccttttcttattttcatgaattgtgcagacctcagtttgcaggaacatttgccactagatgggaccttatatctgtggtaataatctagcagccaacttcttttcatccagtttttataggactcaggaacacaaaccttcttaagaaaagtaagtctttattgacaaaataaaactttataacttacgcaactagccagctgggtcattgtaggattatttcctcactgtttctcagtagatgatcgaaaacataacatttagggcaatttccttgaatcaaacgatgtcctacactaaaaaagcagcaatgtgcctttctaatactctcaagcaagacctctgcttttcctttagtgatacaatggcaagcttggttaaaacattctctagaatttatctgcctaagcatgcctgtgacctcttctagttgccttggaagcactgcagttttctctgaaaccagatgtatcaagatttttttttctaatatcatgatttcttatgctataaagagaaggtgtgtggatggcaagtgaattttgctgtttgttaaccaaactaccctgaggcaatatagagtaggaattaagaattcggcttctggcaataatggtggactagaaaatgtaaaaagttttagcctacaaaaaaaaaaaaaacatgtaaaaatactggataaacattgcatgtgtccttttaaatgaaaaattgagctcacaatatgtggaaacaaaagcaaaaacaaaacaggagtcaaaaccaaggtgggaattttaaacctgagtggcatgttcaggagtctatgttgcagcttctctgcaagtaggtaacataaagatatgggttttaaggctaaggttgtcgaattaggaggtgatgactttggtcttcataaggtagggttttgcaaatgaaacccccgtatgttgccaatatatggacccccagaatgctacacttccaaaaagaatatactgaaagaaatctgcccactcacacaaagggataacaaagaagcctgtctgccctggactgggctctgggtgaaaacaatagaaaattgttattgagaatttataattatgggcctatatcaaggatggatttagagttgagtgtatactatccatgtgttctaatgactaccagtaagagaaattaacattaatacaaaggattagagagcctggcagaggcaaatgcaaataagatcacaacctaaagttaaaaattatataaggaaataatccaactgaaacaaaaggttcaccaaactataagattaggtccctaagaatttcagataacacagctcttgtttagagactgtaaaaaatgcatacgtttaaaatggttaaagaaagaatgaaaagcataagaacaaagcactatttttaaaaagagatcatatagacttaaaagaaagttgtcctaaaaatatatagtatcaaaatgtgaaactcaatggaaaataaaagctaaagggaaagttcaatagcaaatgaggcacaaatcaagcaagaattcatgaacttgaatgtgtatctgaggaaattacccagaatacagcacagagatataaagagatgacaaatctaaaagaaatgttaagggtcatggaggatagaatgaaatgatatgatatggatctaataaacattctagaaaaagaaaataaagaaaatgggaagaaataatgatgatggagaatattctaagactgatttaaaaatctgagaatctgaaaaaattttcagattcaggaagcatgacccgtcagtaggaaaaaggaaaattcatagttagattatctaaggcagctatgaaaatgcacctcccaatctatttatgtgcataattgaatgatagccccagctcctgaccttctgaatgtagtactggattcatgctgagtccacacttcttatgggctacttccagccaatgactgtactaatacaggccattcctacaagatggaggacccctataatgggtaactttggttcaaggggtctccatcagcctggccaaaactttcttggatctgcattgtagtctgaaactcttcctacttaatattccctcttatctccctcttcacaggtcagaccctgcatcattctaaaggttctccctcccttctcctgctccctctccattatccttcaaaggatcctccaaaacactctagcacatcttattccatcttggcagctgcttcttggatgatatgaactaacacagcaccatacataaagatataatagaacaactagatagaacagacagattagctacaatgaagctataattagttagaataacaacagattacttaatggcaccataaaccccgtctctactaaaaatacaagttagccaggtgtggtggcgtgcacctgtaatcccagctactcaggaggctgaggcaggagaattgcttgaacccgggaggcggaggctgcagtgagccgagatcatgccactgcactccagcctgggcgacagagcaagactccgtcaaaaaaaaaaaaaaaaaaaagtatggaaaactgttgtttgcttacctagcagccattaacctcttttgcattgctaacagaattcttacattgttcaggtatgaaacatgtgccccactccaaactccattactggtttaagcaagtcataatatttcattcttctttgccagtgactatattagtgggtgagcatgccacccaattctggctgagaggaagtctgaaaaaaggtttctggaaaagattatcttgtctgatagcgagagagagataggcaaggagaacttggctcttcctttcagcctttggacattatcatcgtgaggacatgatgtttgcagctggctgttatttaacaactataaaagaaaagccaaaagtgtcacagagaagctgactcagatttgtggtatattgagctgctcaattaaccaaccctagtactgcctagctctgaactgcttgttatggtagaaagtacaggtgactcttgaacaacacgggttggaaccctgcaggtccacttacatgctgatttttaaaacacagatagaaaatacagtattcatgggatgccaacttttggtatgtgctagttctgtggggcctactgtgggaattgtgtatgcaagaattttgatatatgaaggggtcctggaaccaatctccagcatttactgagctatgactgtgtacatctttattgttgaagacattattgttggatagtatgttacttgtaccaggaataaatctgttagttcatgaagtaatattttcaaaatgcttagagaaaacaactgtcagtattgcattccttatctagagaatttcttagtcaagactgagggtaaaatgaagacaacttcctacaaagaaggagactttaccactacagacccttgctgaaagaattatgagaggatgtacttcaggaagcataaaactgaacccagaagaaaggcatgagctgcaagaaaaaatggtaatgtaagtggtaaacatgtgggtaaatctaaataagcattgaatgtggaaaatattataataaataattttggggtgttaagaagaagtataatcagaatactggatgataattacatgtaaatgaagggataatgatcaaaattaaaacaatttaatttccatctgttgtttaggaaaagggtagagatactgatttaattttagactttaagacaagtaagaatgaaaacaatgaaaggtatctacaaaagtaataaaccttttcgatgaatatcgattgaaaagcataccaaaaatatttatctgtttatgtgcaaagtttaaagttttacaaaattttatgagtaaatattaaataacattttcagtatgtcataaatatttcataacaggaaaataaaggccaaaagaagtgggagatagcaaaaaagcataataaacttgtctggacatgttggaaattagatgggctggacacacaaatattccttttttgtgagtagccttcctgaatcactttcagtgatagtctgctaattgaaaatgcagagctcttcttcacagaggagacagacataaagaagagagggatccaagcaagcagaacttttaaatttagttttattattttattttttttaattccaagcaagcagaactttaacactcatccactctagcttcatcaacatcttcatttatttttggtttttgtatcttgggtttccgcttaaaatattgctttaagaaagggttctgcaaattaattctaagcagtcatcctccttctcatgtttcctcccagtattcctgacattaaactcctgaatctaaaataaaagttggaattatttaaaaataagtaaaataaaattaaataaaactcctgtatactaatactaactttctgcttactgctcttaacctctgaaggtcacaatgccaccttctgttagcttgagatcagtgttagtattccttttttgaaaaaaacgccacttagtaatcctatgtctgaattctgattgtattcaatgtagttatataaacttaacaggaaggaatgagtcccttctgacaaactgttgtttcacttatggtccttatagccctgagttttgtctttggagtactttgtcaagtattcaagggttctactgaaaagttagtactcagcttaccattggcctttttgactttgaagaattggtaaagtcaccactcatcattttccccaaatgtaagagtctcttccattattcagtctagtataaattcatttttcattctctgaattttattcaattccattttatgtattttgatgtgcagtgactggaagagtttaggtgcagtagaattgtgcaacaaggaagaaagaagtattctatttaattgccaatacctttcctgatgataattaacatttaaagtgtggaatatccttccttgtattgataaatttgctcacacaaacatatataatattttatttgccatttcaaataatttaatattgcaaaggtcagcaaaccttttctgtgaaggactggacagtaaatactttaggctttgcaggtcatatagtctctgtggctagtattcaactctaccagtttagcaccaaagcagccacagacaatgtgtaaatgaatgaacacagctattttccaataaaacttgattttcaaaaacagtcgataggccagatttggcccacaggccatagtttgctgacccctcttgtactgtcttggttttcattatccagtggattcgtttcaggaaacagagttcactaccaggatatttaattgttctcttaaattgcaaactacttttgttccagtagggacagttaaatgcctaggcagataaaacggggtccctggagaatctgcaactggcctgcgcactgggaggacgaggtggagccccgggaagtttgcgttgtttgcaggtgggaggagcctggactcctcagtttttatgtggtgacctgggattcaatctgtgaggcagagggcttgttagcaggactccatctcactttgctgagttttcttcctttttatccttttcgctcagtaaagtcctgctcccctcacccttcaatgtgtccgcatgcctaaactttcctggtcatgtgacaagaatctgggttttagctgaactaaggagcaaagctctacaacacaatgagtggaattttagtgcaaaaatttgcttttgaggactgaaataaaataatgttgctttggtttttcaatattctaaaggtatgtcagcttaatagtcaagggaatgcatttatatttctagtatattttaagccataaaaagtaaaagaaggaatttcatctgtcaatgtgagtaaatcatatgcaactcaatcacctcaaggaagattatttacaaattttacattttaattcgtagatagcacctaatctgcctataattttgttgacagctgaatttctgctattttatctgcctacagagaagcccttgaaattgtagaatctgtatggtttactgctttatttgaacttgatttctgaagcatctgtataaaaatttaagtgaaaattatatttttaattagctgccatttatatttaaccaaacaattcatctttattaaaaaatatggatatcagcagggtcatggtataatgtatgctgattacacactgtacaagagtgctccatttcagagtgtgccattcacattggagatactagggatcgtagaggataatgaaaatcaacagacttattaaaaggtttctggaatatagctgtagagagtcttattctaacaactagtattttacagtaagtttctgatggcagtaaagtgtcttgagggaaggctgtcattcaataattgtgggcataggttatagcctacctctttgacaatactgcagaaaagttaggaaatcatgaaaagtttatactgccctcctcaaagacgattcatttctcatgcttctttacagaggggtagttcagtaggcatagtgcacgattttcttataagtcccgattgcagtgctttttaccatacatttaatagaataagcatttagatcatacaaggatctaccaggaactatgcagtgctttcttagaaatcttgcttttcttttaatgtcatgttttaagttcccctagcacttgtaaacgtatgccactgagggaatggttttcaaattgtatttcatgagcacgtcttagggactaggatggggcctgaagctttgagtatctcacctttacttttacccattatatactttgaggtcacatataggatctttgtgcaaatgggaaaagttttaaaactgttatatgcagagggcagttccaaatacactttttcccctggaagttgactctaactgaaagatgccaacaacaatatttgtggcagtagcaattcccactctttaaacacctcatacatggtaattcccaccatataatctctaattctcacaaatatcctgcaaggggtagttgatactattctcattttacagatgaagaaagcaaggctcagaacatttaagtaacttgcttaaggccacccagttagtaagtggcaaattgggaactaaccttaagtctgtctgacctcaaatattcacaatcccatacttttattttaatataagttatttattagcaggaaaacacaaaagaggttttagataccccccattttaagaggatcattcttcccagtatagattagggattaggctcatggaaaattaaaccacaaggtctaaattacaatatacttatttagtgcataaaaacacatatgaggctagacagaaaaatgccaatgaaataaaattgcattttcaaactccttgcccaagcactcatttctcaacttattatcttattctgaaatatctccggttaaaattacaacccttcaaggaccaaagcgtgcttatacacttcaaacagtaaatttcactaagaaaatatggttgttagcttttaagaaatatagttctgctagagtaagagaaattcataccattggtgattcacatcacataaaactttatttgttgcctcaatctgattttgaattcaagatggtgtttggtgatactattatttcagttaggcatctctctttgagcagaaattgggactttagatggcttatatcagtgatggtttgcaactgtgatttaaaacaaccaaatatacctgcaaatgactttgtagcctcaggagaatgtaaagtgaggtcaccagcagggacaagcagagccttcagtcactgatggaaaaatcattatttcactacctctgttaattagttagatgtctgaagttgaagagaagtgtactagatacactcgccaggactacaagaaggcatataggaatagaatccattattttctgagcatctcaaaagggacaagtactatgcacaagggtacagatattaacacgacttggtccctaaattcagggaacactaggttcagggaacactaggcttcatctcttgccaacccactttccttgtcataccttcatctttgctgctgcattggaaagacctttcttctctctctttcatctttagtttgtgtggtcacttgtactgttattccaagacaagctcaagagtttcatgcttaacaaagatttttcttgaacattccttcctttgtgccccaaccggaccattctatcataccacttgttaaacattattgtactggttgtttacctttatgttaaccttactgtcccatattacttatttctaataaatccctcaaaagtaagggttattttttgtttgtctcattaaataactaatattttattcaacaaatattacttgagcctttttatgaaccagcagtacagttatctaagcacaccatacacttaatacatgtttgttaaatgaaagaataaaatccaacttccaaacttacatcctaatgatcccatgcattcttaaacacaactcttccaccaacccctctagcactcggattcagtttgtgttgaattaactcacatttactgatatacataaaagttgtcaagttgtcatttgggtgtattctctctcctcagatagattaaaaactccttgagggaaagggccatataaaatactctactttattttcctatagctcttgacaaagggctctgatctatcaaacactcaattattaccagtctaagtaagcaatcattttttttggatgagcattattatcatgatatagagtaatcaccattcatctaggctatcaacctattgctcaagtcaacaaactctggcccctgaattctcagtcatcaaatctggtctccaaaatgtatccctgtcttatccctgatgcaagtggctccttaagcattgcctttaggacctgactatctctcacttgcactatgaaaacagcctcttatctgctctcctgcttttagtatctcctcctacaatccatcactgacactgcaaccagggtgggctttctaaaaactaaatctgactatttgtgacagagaccaccaagttgttcactacattcctctcctcttcttccaaggaagaagttagacctcatttcccaggctttcttgcagataactgtatacatatgactgagtttagaaaatagaagtgttgagtaccatttccaggtctggtcaataaaatcttccactcatgatctttgctctcctcctttcctctagcttgatgtagacaaacatggcaacttttcaagccatgtgttaaagacagtggcgctacaaggatggaaagagcctgtgccctaagtcaagcccaggagaacagcctactaatcaggaattctccagttgcattttaggtgaatgagaaacaaactactatttttgagccattgtacaattttaggttagtttgtaacagaagctagcattgtcttatacaccatacactgtgctatttctctgggcaagatccttaattcactggctatcatattgtaggcaaatttcttggaacaacacctataaggcccttataaatccaaatgtgactcactctatagtctcattctacttttaatccttgactcttacccccctcccatgaccatatataccataccctatgcttcaaccaaaatgacttacttggtattaccagaaaaataaatactttcatgcctacatatacactgttctttcatcttggaatacatccccttccttcagtctcatacctgaaatttctttttatcattcatggaccaattcacctcatcatctctcatacatctctgattctctttgtcagaatcaattgtcctcccattgccactcccataacacatttaaaaaaatctatgtcatagcattaactacattttaaaagctagattgtcatcaccttgaagaccgatattgcatcctattcatccttataacctccgagactcttatacacagcagatactaaaaaatgtaggtcaaactgatattactcatttatttaacagtttaaactttttgaagtatttttcatatacattatttcatttttagtttcacaatgattgtatggatttaattgacttgacttaaataaggaaaaacagttaattgtagagtgcagtctgacaatattctgacattgggcatggttatggtttagccacctgaaggagaaggaaaagaaaattagttgggtaaagctacctaaccagaaaagttcgttcataaaaatgataatgcaaatttctctatgatatgagtgtactcagtctgcaagtttgtgtatgtgtgtgaaagttgtactagtagtagcaaatttatgttagataatttaagatttaagatgatttggaaagatacctatgatatattgtgagtgtgagaaaagcatattgcagaaagatgatatatagtaaagtttgacttgtgtaagaaatatcaggaagaatactcatctctcagagtagaatagtgggagaaatagaacttttaagtgtacattacataattctgtactatttatttcatgatctagttattatataaaaattgcttagaacaatctagcatatattgtgttatacacatactcgttatttttatgataagcatgtgttataataatttttaaaaagaactcactataaagagcaggaagtaatgtcgaataagtggtgagaagggtatagtttagtaagcttctatcataatctatctttctgcaggtgataatcactagacaaaattcaataaaaaaatcgatgacctttaggaactggagagtgaacaaaagaagcagattatggtggggaatcaacacttggaagaagggaaggcatgggttaatttccagtttttatttatttattttttatttttttaaaccagaaggtaggaaacaatgaggcagcacagggtggcagaaatcttgacagaaaactctcagtatctctcacataaaaaaatagggaacagagtttaggcaaccacaaccactggaaagtcaagggggcatcccccaaaaaagataagagagagaatgcaccccatattctgtatataaactctgcccaaatctctccctgacctggaatcatgcatgtgtgaggctgactgcaactgagaatgaagaaactcaactgagatttgagctgcagctcaagaaacagaatttgtcattggagtccaaaaaatttaattgccttctacatgaagagaaaaaaattaaaactatttagaataataatagaacagaatctacagtctccacaaaataacaatcacaatgtccaaaatacagtccaaaattatttaaaatatgaaaaacagaaaaatgtgactcattctcaagagaaaagacaacctatagagaataactccaagaaaaccagatattggaattagcagaccagggttttaaagtagatactataactgtgctcaggatatgaaggaaaataggcccacagtaaacagaaagaaaggaaatctcatcagagaaatagaaaacaaaaaagagaatggaaattctaaggtgaaaaatcacagtatttgaaataaaaagtgaggaaagacaagtcattcatgatcatgcctaagtctcattagtctcttcatatacagcagccaatttttagatatttgcttagctcaccttccctttctctgaaaactgcccactatccacagagataaggctcctgtggcagttatatgattcttcctctaatattctgagagtcaaatactctggcagctggcccctgatccaagttttactaataagatgatctctcctgggattttaaagttgggacagaatattagttagtcaggttttaaaatttgagatattatgtccattcatgatcagaagtatggccctttctggtcacatacagagggaaggagagttcatctgcagagagaataaaacaaacacacaagaggaatacatgaaaaaattgagggtgtgggagttactgatttctttccaattcctagtccagtccctcaattaggccttatagtgatttctgtccttgggttctgagatactcctatattctaataataaattgaatttctcacttttttgtttacatttctgttatataccatcaaaagaatctcaattacatggcaatgtatatttctattctttggctagtcacctattgaggaagcgttggatacagcaatggtttgaggctattgtaggcaatatggacatgaaagtcctcccaaatttaaaagtaaagaccattaattgagaataaaattaggaataaaatgtaatgaatgagattagttgtagaaggagcccattctaagtaataatctgtaactgagtggtcaagtattttaggaacagccagatgtgattaagctgatatggtaatagttacagtagtgggaagaaagaatgtgctattagaaacatgggacatagaaaaggagaatcatagaaagaatttatcattgttatccttacccatgctgtctagttaaacgggtcaccttattcaggaatctaagtatctgatgctgggccaggcatatcccataatggactactcagagtttggtcttccaactaacttcttttttctctcatatccatccttgtaaaggaaccttctggttatcatttggtttcccatgtagcttcccaacaggaaacaatactttgaccaaatactttgaccactgacaagaatattttgacttgctttgaagttatattttatattgtaaatgaatcagttgactgactggttttatacatcagtctcaatttggttaaggtaaggcagaccttagaggtcaaatcactttagatgctgtaacaagtgctaaacagaatggacttgaagtaacagataatggaaaggataatacttcctcatgagacccgatttgtcagccagtctcctggacaatgattctatcttgtcatgctgtgtaataaatattcaaaatggtgacatttcaaattattcacaaatattgtactttgctcaatagtgtttactctaattttgaataatccatgaatatttggagcatcttatagtagcttcatatggtgaatacatttgcctcaagtagcgtttatatagggcccatgtatttactattagtataataggtcaatgttgctcctgaatataacaataatctacatatatacaattttttggagaatttccaagtaaagctagaaaatatacatcgtaagaatgttaactataaagcataatatatattcactatgatattatcttatttggaagcaggaagataatactgcactatattctctatcttaaccatgctttttcaaattgggaagcagttgatatttgtacaggaagacacgaataaataggtatttgcttctgccattcagttttcagatatatctcttgcatatccatcatatgtgatctggcaaatgtattattatataaataactggtgctctgttaaattatattttgactacatgatttaaaataaacttgtagtaaatcgtttcacaaaacaaagagtctccctttcatatagactactccctctaacacctactcacacgaatttaggtttctggcatgcaggaggactgcgtggtcaacttcaaaggatttagtggtccatcagtcaacatttaaattattttttcaaacactgatgaaattcttaaatgaacactatccacaaattgaacatttctggaaataaactgtatccaagtgaaagggcttaatagaaccatatatatgcaattgtcacaaagcaggtttgaaaaaccaatggagtcttgctgttcccatgcctgagttttaatatggaaaacaatattattatggttcaacaatttgttagttttttactgagcaactgtttatatggacaaagctagtaatttctgaatgcttacccttccccttcctatccatgataaggcaaaaagcaagccagaaagacaaagcaaaggaatgaacatgacctaacaactcagtaaaaatatgtactcattctttaatatgtaataataaaaatatgtactattctttaaaaaataatgtaactcaatataaatatatgacatcaaaatctcaattcaaaagaggttaacagttctgtactcacgggagtcttatactttcagtattcatggaaacattagtaatttcattcaataccctgttttatcatttaaataaaaaatattattgcccactcaacacaactctcaaagtattatgcaacatttcattacagtgctaatttttaaccttttatgtacaaaagcagaggcatattaattggaactgatttgaggtcatcagctatagtactgctcagtcattgaagttaatattctgtgaaaatatctggaaagtgtattattaataacaatgtatctccagacacattttgtgtatactttcaccatatggaattaactcacttaaatgattttacaaactttgggaaagtttaccctcttgtaaatcttgcctggatgttactggctatacacagaatttgaaataagtttgatttgggcccctttcctttttctttaatcctttgatttcaggccctgcctttagcaatactcttgatgtaggtgatatccattgcttatggtatcagaatccacctccatcaaaaagatgttggaaagtcacaaattctcaacaggttatctcttgtccctagagagcatattcagataacagcattgaaatttgcctgtttggggagaaaggtattctgacaatggtgtaagcttttctattattttctaagattagactaaaatataagctcttaatattatctttacaaatttccaataaaaatattttaactcctccagttccctaaaggtgtgctaaattatttacaatgcttaagaatgctagagaacaatgaaatgagatagattctataatatagtatatgtgcttcagcactgtattagtctgttttcacactgctgataaagacatacctgagactggacaatttacaaaagaaagcggcttattggacttacagttccacatggctggggaggcctcaaaatcatggtggaaggcaaggaggagcaagtcacatcttatgtggatggcagcaggcaaaaagggagcttgtgcggggcaactcccgttttaaaaaccattagatctcatgagacccattcactatcatgacagcagcccagaaaagacctgcccctataattcaataatctccccccaggtccttcccacaacacgtgggaattatgagagctatatgatgagatttgggtagaacacagagccaaaccatatcaagcactaacataaactagcaggaaagacccatccccataattcaatcatctcccactggtcccctcctataacacacggaaattatgggagctacaatatgagatttgggtggggacacagagccaaaccataccattctgtacctggcctctcccaaatctcgtattttcacatttcaaaaccaatcatgccttcccaacagtcccctaaagtctcaacgcatttcgacattaactcaaaagtccacagtccaaagtctcatctaagatgaggcaagtcccttcctcctatgagcctgtaaaatcaaaatccagttagttaatttgtagatacaatggggatacaggcattgggtaaatacagctattccaaatgggagaaactggccaaaacaaaggggctacaggccccatgcaagtttgaaatccagcaaagcagtcaaatcttaatgctccaaaatgatctcctttgactccatgtctcatgtccaagtcacactgatataagaggtgggcttccatagtcttgggcagctccgcctctgtggctctacagggtatagcccccctcatggctgctttcatgggcttgtgttgcatgtctgtggcttttccaggtgcatgatacaagctgtcagtggatctacaattctggggtatggaggacagtggccctttccttacagctccacttggtggtgccccagcagggactctgggttggggctttgtcccacatttcccttccacactgccctagcagaggttctccatgagggcctctcccctatagcaagcttctacctggatatccaggcatttccatacatcttctgaaatctaggtggaggttcccaaacctcaattcttgacttctctgcacttgcagggtcaataccatgtgtaagctgccaagacttggggattgcaccttctgaatccacagcccgagttgtaccttggccccttttagtcatggctgcagtggctgggatgcagggcaccaagttcctaggctgcacacagcaggggggtcctggacctggcccaggaaaccatattttcctcctagacctcccagcctgtgatgggaggggctgctgtgaagacctctgacatgccctggagacattttctccattgtcttggggattaacatttgtctcctcattacttatgcaaatttctgcagccagcttgaatttctcctcagaaaatgggattttcttttctattgcattgtcaggctgcaaattttctgaactttcatgctctgtttccttttaaaaactgaatgcctttaacagcaccaagtcactcttgctgcttagaaatttcatccaccagataccctaagtcatctctctcaagttcaaagttccacagatctctagggcaggggcaaaatgctgccagtctctttgctaaaacataacgagagtcatcttagatccagttcccaccaaattcctcatctccatctgagaccacctcagcctggatttcattgtccatatcattattagcattttggggaaagccagtcaacaagtctctagggagttccaaactttcccacattttcctttcttctttggatccctccaaactgttccaacctctgcctgttactcagttccaaagtcgcttccacatttttaggtatttttttcagtagcgcctcattctactggtaccaatttactgtattagtccattttcatgctgctgataaagtcatacccaagactgggcaatttacaaaacaaagtggtttattggacttacagttccacatggctgagaaggccttataatcatagcagaaggcaaggaggagcaagtcacatcttacatggatggcagtaggcaaaaagagagcttgtgcagggcaactcccctttttaaaaccatcagatctcatgagacccatgcactatcatgagaacagcacaggaaagacctgcccccataattcagtcatctcccaccaggttcctcccacaacacatgggaattatgggagctatgagatttgggtggggacacagagtcaaaccatattaagcactaacaaataaactagcaattcaaaggtagcacaaatgtagctcaaattaggctaaggctttcatttggaatgtatgtggttgtactttgtcatatcttaccatattctcctactttttctaacatttgatgacatttgtatggcgctttatactttacaaaatggttccacctgactgtttttgggtacgaagtcactcagagaaagtcagaggctacaaaagctactccataaactatttccaaatacactctcattttctccaagagccgtgaggagtactacttctccaataactttttattgagaacatatctgaaaaaagtaaagttaatggaaaagaggaacatcaaagactattaatttttttagctgctccaaattaaatccaagttaacttggatgagtaaagacaagtttatttttctctattattcagcaaagaagagaaatttgtaagcaaaaatatgggagtagcatttaattttggctgaaagagttttataattttaccatttagccatgtattatttatataatactgatttatagaatacttatttatatgtataatattgacagccaaagaccaaaagtaggtaatgtccacaatagaaataaaaaaaatagtaaatgaatgggttagcattttacttaggcttctactgtgaagaatactaatttgttaatgtgcaaggtgacacgttaaagtgctaaattagcctgagcccttgttgtaaaatttaggcaagcagaaaagttcaaataccttatcacatattaattgccaataattacttgcatcaaggtaacttgtgttatttaaaataaattaacagatacagaaagaatcctagttaataaatttaccaattatctgccttggtataaatatgaatttatgttctgtttttagtcctattcacatatgactatgcattctatttataacgatttctgaaaaagcagcggttggctacatgacctgtcctattttttgtgaccatcatttctttatctcttctctcaatgctttctcatagaatgaaagcatcaaagcaaatgataacagtctacatatatacaaaatatatcactaggaaataatttcttttgaaaaaagttaccccatgaggtgcccaaacaatgccatacataaaagataaacaattcaagccagccactgtataatgagatttaattgtctcccattcttttaatatgcatggacaaaaaacgcttcttttccattacctcatcttaagtagttttttaaatcaaacacatactcacgctcatgctgtcactgataatggatctcatgtcaaagaaaaagagcagaaaggacctgataataagtgcaattatcaaacatcaaaaatgtagatcaaagtggatttcctgactcttctacatgcagtcacttcacagaatttcactattcatattatgtgaccctgacaggatatattaattttctccattatgggagcaatgggataggcatacttcagtaggaagctggcaataagtagagttattatttcactgtcttatttaatggcttgtgtgtgcataattgcgtgtgtgtgtgtgtgcatgtgtgtaaaatatgctccccagacacaccacactgtgtctccagagttgacagaaagccttcagggagatgttaaccttcctatgaaggatggatccagggaaggattttatttctttcagatagtacaatatttcctctctctgggaaacacccgacctatctttgggaggactgaattatctcagagggaaattgggagtacttctagaagtttgccattctgaatcatttcaataactcaagtaatcaaatttccacttctacccccaatcccatactccttcctttccccagaactttccttgatacattttttatttgaaaaataaattcattttcttttcctaccaaatgctgaataaaaatcatgtgctaggtgttctgtagtgaaatttccagagtctatacagcctacacagatttccagtaggcataggtcgttttgtttttagattgtgcctatcagttggtcagtgccttaaacatgccaatgtcacaggaatgaccatttctgaactcacattcatccgaagtattcttgaagattataagaagagagagaattttctagttcttttcacaaacatctacctataattccaagggacagactttgacagtaataaactctttagagttgtgttatgccatttctcacccagaaaaaaagctaacattgttacatatcttttatgaaaattcgaagcatatttgttagaagggaaatagaccatttgcaaaaggcaaagggcaagcccataaggcacaatgacagatgaaacctagccatgagaaaaaaagtatccctaggatgaaaaaaaacattttaataaagcaaaacactttcaaattagtaaattaaaaatcagttgattacagcaaagtttcaaggagttttaagtatttcgaagttaaaaaataactagacaatatcattatttttaacttaataattttgctttgttttacacatttcagtcaattaaacttctctgtatacttgggcagttcttgaatgttagtttgaaaatagactaatttctaaacatgggccctaacatatggctaagttaaattaaaaccctatcattaaagaaacaaatattacaatatatagattagtcaattaacatactttttttctatggagtaaaatgactctgaacctggaacagcagctggagttgttcaccacaatagtattagatgcaagtttctggaattaaatgtgccaggcaggaaaataattttatagtcttttcctcatgggaggaagtctggataaagagtgtgagatgtcagacctcatcaataaattatgatcaatataatagggttgaagaattgggtagtggtttctatgatgatcagtaaatactactctggtaattatttttaaggggcaaagggctaagaaatatgagaaaataaaaatgaaataaaatagaacaaaatcacagaatatgtagactggaagcaggtatcttaatattatacaaccatcatcataattattctccaggccataaaacatgtagaacttacaggacaaaaaataatgaaaactaagatttctctggtagtcttggtaaaagacctgcttattagaaagacaaaaaagacatttacaatcacatgttatattatactgaaactgaaatatatagtgtaatggttaagaccatgggttctggaaactgactgccaagattcaaatcttagcacaccaccaaatgccttggtgaatttagaaattacggaacttctctgtgtcttcttcttcatctgcaaaagtggccaaacgcatatttcatagctttctgcagagaactacatgagttagttatgtaatgtacttagatcagtgcttggcatacagtaagtgcttactaaatttttcatttttattaataaaaaggaactcaaaaatttacagaaaaatatctagtagcagacccggctctctccaaagttgtgaaatgactcagtttcttttacagcactatttccatctctttttaaaaacctctttccctttctatcttcctcctcttctcccaagtggccccttgccctctggactgtgaaatcccacccaaatctgccttcttaatagaactgcataatccagaccttttaaataaaaaccttctgtatcccaacggaactcattcaccctctggcacattgtctcgggtcagtctcaggaaacaatgtctaatatgtggaaccaccattgagatagtgctgatattttgagtagagccatcaatgcctgaatccaaaggaataagcattcgggaactaaaaagaactgtaatgactctaaatgtcgctgtttgctgactcctcccagtcagtagcaggctaactatgtgctcctcaagcctaggtttgtgtatccagccaaaattcaataacagtttggatatctcatagacaagtatttaacatacctaaaacataattcttgattcccctattttcactatgcccttttgctcatctagcctaagtgacaccacaaggtactcagttgctcaaacaagataatagaatcataccgatttctccttgtgccttaacttccacatgcaatacgtcaccacattctattggtttccttcagaaatatatcttctctctatccacctctctctgtttccaccgtcatctctcatctgaataagtacaatagtcagcttcctggtttccccacttccaatccccccgccaacctatttactgtacaatagtcagccctagaataaactttaaaaaaacaaaactgaacatcccaccccttgcttaaactccttcagtggcttcctattgtacttaggaaagcatttaagctcattgtaatggcctccaagaccttctgtgacctggttgctgtttagcttagagtttcctctgttgagctattctccccttagtctatcacatttttgacacacgggtctggttgcatttcttagatggggtcatcttcttccaccacaggccctttgcatatgccggaaagggtcttcctgccctcaccatccattgaatgattgattttctcttctcatacttcaggtcccacctcaattgtcacctcctaaggaaggatttttttcagctttccctactgttaacgtagtttccacaatcacctcccttattctctgaaatgaatggtattaccatatctacatatttctgttttgactttttgcttctttctcccactgggatatagggcagcattgttcaatgttacatctctagcatctggcacagtgcctagcatgttgttaagtgctcaaatatatactgaatacataaataagtagtagtttcaatacttgaagcctagtagtttcaatacttcaagcctagcatgttgtaggtgctcaaatatattctgaatacataaataagaagtagtttcaatacttgttgaatgcatgactgggaggggatgtcctttatctcctcaaatgaaaagatgtagatagcttataattcctgcataattgctgcaatgtataagactaacccattatctaaaaatagttacctcaatacaatgtccatgtggcattttgatcatacaaaagctaactatcttgcaaagagagctaatattttagtggtaaatatgatggtaagtgtaatatagcctgtttttctttgtcatactatgttccagttagtgcctactatacttgtgaagtgtctttgctttctattgaagtagtaagttcagtcacctcttttaattcagaaaaaaaccaccctaagagatgaaatgtcactttaacctaaggtggcagtttctttttttttttaaatttaggcggtggtttctgagtattcagtatgtaatgtgataataacatttttgacaggccaaaatgtggaacaaaagtgggtttaaaatgaaaggcatgagacagctctggactccagcttattttgaggatctgcttctgaaaatggcctgaaaaagcaacagaattgcttttcagaattgtaacttgattataggcactttccttttaaagattagtaagggttacttggttctattttacttggttctattttattctaataatactctaatgatgtcaattaaaaatcactctcatctactctcaagggctgagatagtctctcaatcaaactgactttattagctttcattttgatccatgccatcacattcaaagaggattttctttttacaagaaataatattaagaaaattcaaaaaaagagccagcaaaatactttcatttccagatttactctttaaatctaacgaaaatatgacaatcttatttgtgttacctttgcagtaccataattgttctctgtgagaaggaagttatttcttatgaggaattcatatccctaactcctttaagtgatttggtatcagattaaatattaatttgaagtacatctgtgcttattcagttcagcaggtcctgcttagaacacattttcattttgcagccatggccatatgcactacattgcttttccaccagggatcactattttggaacagataacagacccttatgacctttgcattatattttatgtacttctctatccaagtcaatttataaaatcgggacttctcgacttaaaaacacaggaaaatcttgctgttttcttctttctaaatcaagtaccttgagtacgactatcttgggactggcatcaaacatcagattttaaaaatattgttctctgctgggaagagctcattattatactaaatatagaagatatggtatatcaggcagaataataattttatataaaatatcaacctatcttttctggaatgccagatacagtcttagttacttaagcctcaactataagatttacacttaaggaatttgacatttattgttataattggcctctttatgaaaaaaagagacattttcctagattgtgaatgataattatatataactgaattttaccttggtgtttaaagcaaccatttgattacaatgagtatttctagatttctactagcttctctttcatgagaatgtcatggttaggaataaggaacatcagtctaatttgaatcaatttatctaggagttgaaagagatatagtcatttctctttccctagccacttcaccatgagctcacttccacgcttcttccaactctgaaatggattagatttgtatttgttccgtgtccaaaagtagactttaaactcctggcatttttgggttgtagcttactcaattttgtagcccatgaagtgccctgtatatagtaatgagtcaaatgtctgttgaactgaagttcgtgctgatgtgactgaactggatgggtctggctttctctcttcaatcaggcaagtagataaacaagggcaacctgcagttgattattctttgaggggttttccatagcacatagttccttggggctgcccaagatggattttaggataccttcttccactggctttttagtcactaggtattcctagagacttgtccatccagatataaaattactatgatgaggctgaaggattaaaatactggaattcaagaacttcctttcaaaggcccctattaacttggttgcatttttcagagacagtggcatgacttatttttccctggaaacataattaaagtgttaacattataacagagttagctaggtaataagagtctttgatgaaggatgggcttattagttgttcttaataaagggatttggttacttgataaagttagccgtaaaggttttttttttttttaattttactttaacttctgggatacaaatacagaatgtgcaggtttgttacataggtatatgtgtgccttggtggttttctgcacctatcaacctgtcacttaggttttaagccaagcatgcattagatattgtcctaatgctctccctccctttgtccccaccctccaactggcccaggtgtgtgttgtttccctccctgtgtccatgtggtctcattgttcaacccccacttatgagtgagaacatgcagtgtttggttttctgttcctgtgttagtttgctgaggatgatggcttccagtttcatccatgtccctgcaaaggacatgatctcattcctttttacagctgcatagtattccatatatgtgccacattttctttatccagtctatcatcaatgggcatttggcttggttccaagtctttgctattgtgaacagtgctgcaagaaacatacatgtgcatgtgtctttatagtagaatgatttataatccttgtagtatataacccataatgggattgctgggtcaaatggtatttctggtactagatccttgaggaattgccaccctgtattccacaatggttgaactaattaacactcccaccaacagtgtacaagcattcctatttctccatatcctctccagcatctgttgtttcctgactttttaatgatcgccattctactggtgtgagatggtatctctttgtggttttgatttgcatttctctaatgaccagtgatgatgagctttttttcatatgtttgttggctgcataaatgtcttcttttgagaagtgtctgttcatatccttcaccctctttttgatggggttgttttttttcttataaatttctttatgttccttgtagattctggatattaaccctttgtcagatgggtagattgcaaaaatattctcctattctgtaggttgcctgttcactctaatgatagtttcttttgctgtgcagaagttcttcagtttaattagatcccatttgtcaatttgggtttttgttgcaattgcttttggtgttttagtcatgaagtctttgcccatgcctgtatcctgaatggtattgcctaggttttcttctagagtttttatggttttagattttacatttaagtctttaatccactttgaattaatttttgtataaggtataaggaaggggtccagtttcagttttctgtgtatggctagctagttttcccaacaccatttattaaatagggaatccttaccccattgctttttctttttcaggtttgtcaaagatcagattgttgcatatatgtggtcttatttctcaggtctctgttctctttcactggtctatatatctgttttggtaccagtaccatgctgttttggttactgtagctttgtagtatagtttaaagtcaggtagcatgatgcccccagctttattctttttgcttaggattgtcttggctatatgggctctttttttgttccatatgaaatttaaagtagtttttttttctaattctgtgaagaatgtcaatggtagtttaatgggaatagcactgaatctctaaattactttgggcagtatggccattttcatgatattgattctttctatccatgagcatggaatatttttccacttgtttgtgtcctctcttatttccttgagtagtggtctgtggttctccttgaagaggtccttcacattcctagctagctgtattcctaggtattttattctctttgtagcaattgtgaatgggagtttattcatgatttgactctctgcttgttttggggctgagacaatggggttttctaaatataggatcacactgtctgcaaacagagacaatttaacttcctctcttcctatttaaatatcctttatttctttcttttgcctgattaccctgccagaacttacaatactatgttgaataggagtggtgagagagggcattcttgtcttgtgtcagttttcaaagggaatgcttccagcttttcccattcagtatgatattggctgtgggtttgtcataagtagctcttataattttgagatatgttccattgatatctagtttattgtgagtttttaacgtgaagggatgttgaattttaccaaaggctttttctgcatctattgagatgattgtgtggtttttgtcattgcttctgtttatgtgatgaattacatttgttgatttacatgtgttgaaccagccttgcatcccagggatgaaaccaattttatcatgctagataagcattttgatgtcctgctggattcagtttgctggtattttattgaaattttttgcatccatgttcatcagtgatattggtctgaagttttctttttttgttgtgtctttaccaggttttggtatcaggatgatgctggcctcataaaatgagttagggtggagtccctccttttcaattacttgaaatagtttcagaaggaatggtactagctcctctttgtatctctggttcaatttggctgtaaatctgtctggtcctgggctttttgtggttggtaggctactaattactgcttcaatttcagaactttttattagtctattcagggattcaacttcttcctggtttagtcttgggatggtgtatgtgttcaggaatttattcatttcttataaattttctagcttatttgcatggagctgtttatagtattatgatagttttcatttctgtggggtctgtggtgatatcccctttatcattttttattgtgtctatttgattcttctctcttttcttctttattagtctagttagtggtccatctattttgttaattttttcaaaaaaacagctcctggatttattaattttctttgaaggatttttcatgcctctatcttcttcagttctgctctgatcttcattatttcctgtctgttggtagtttttggatttgtttcctcttgcttctgtggctcttttaattgtgatgtcagggtgtcaacttgagatttttctttctttcttatgtgggcatttagtgctataaatttccctcttaacactgctttagctgtgtcccagggattctagtacattgtctctttgttctaataggtttcacagaacttcttgatttttgccttaatttcattatttacccagtagtcattcaggagcacattgttcaatttccacgtagttgtgtggttttcagtgagtttcttaatcctgagttctaatttgattgtgctgttgtctgagagactgttatgatttcagttcttttgcagttgctgaggagtgttttacttctaattatgtggttgattttggaataagtgccatgtagcactgagaagaatatatattctgttgatttggggtggagagttctgtagatgtctattaggtccacttgatccagagttgagttcaagtccagaatatccttgttaattttatgtctcattgatctgtataatattgacagtggggtgttaaattttcccattattattgtgtgggagtctaagtctctttgtaggtctctaagaacttgttttatgaatcttggtgtattgggtgtatatacatttaagatagttagctcttgttgttgaattgatcccttttccattacgtaatgcccttctttgtgttttttgatctttgttggtttaaagtctgtcttgtcagagactaggattgcaatccctgctcttttttgctttccatttccaaatcttcctccatccctttattttgagtctatgtgtgtctttgcatgtaagatgggtctcctgaatacagcacactgatgggtcttgactctttatccaatttgccagtctgtgtcttttaattggggcatttagcccatttacatttaaggttaatattgttatgtgtgaatttgattctgtcatcatgatgctttctggttattttgcacactagttgatgcagtttcttcatcgtgtcattggcctttatattttggtgtgtttttgcagttgctggtaccagtttttccttttcatatttaatacttccttcaggagctcttgcaaggcaggcctggtggtgacaaaatccctcagtatttgcttttctggagaggattttatttctcctccacttattaaggttagtctggctggatatgaaattctgggttgaaaattcttttctttaagaatgctgcatattggcccccactctcttctggcttgtatggtttctgctgagaggttcattgttagtctgataggcttctctttgaaggtgacctgaccttcttctctggcttcccttaacatcaaggttcttagcttctttgcattgggttagaacatgctcctttagctcagtggagtttgttattactgaccttctgaagcctacttctgtcaatttgcccatctcatcctccttccagttctgtccccttgctggataggcattgtgagcatttggagaagaggcactctggccttttgggttttcaacttttttttgttgttgattctttctcatcttcatgagtttgtctagtatccatctttgaggctgctggcccttctatagggtttttgtggggactttttttggtgctcttgttgttgctttctgtttgtttttctttcaatggtcaggtccctcttctttagggctgccgcagtttgctgggggttcatttcaggccctattcatctggttcactcccgtacctggagatgtcactcgaggaggctggagaacagcaaagatgggtgcctgctccttcctctgggatctctgaccttggggggcaccaactgcctcccttggctggggggctgggggctcccttgccccatatggctcccacatgggccaccacaccacactgttcttctttcctctctgtgggtcacaccagccgcctagtcagttctgatgacagaacctggatacctcggttgccattgcaggatccacatgctgttatggttcttttcgatgggagcctctgattgctgctggttttagttggccatcttggccccaccccccaataaaggtttcattctaagccccactgcttcagcctcaagtagctctattagtgcaaaaacaaactattgtactgcaaagtagggtgcagcagaaggatgtgcttgttgccaagttatttctattgataacatagtagtatctatgtcatcaatagataatagagtttgctaatagatatcagtagtggctaagggtttgaatacccccaagtaaaattcaaagaaatatttttaaagaggcaaaaatacattaacagtttttaactctttcttataacaaagcccagttcatactactgtaaacaaattttaaaatctactttctcacctctcattcacattttttcccagtgatcaaacattttaatcacatagaaaagtaccaagagtaatataacaaacatccataaatccaccaagggataataatgaatgttaacctttcattatatttgcttatattttttattaaagaattaaagtattacagttgctcttgaaacccccttcttactgcttctaaattctgttctgctcctttgctccctggaggcaaccactaccttcaagttggcatgtattctttctgtcaattacttgaagacagcaagctgtttcttgcttcaaggcctttctaagcgctcttatctcttgctggtatgctcttctccactctcttcacctggatatcacctgtttatccctcaagcttcagtggaaatgctgcatattcatagagagctttctatcctctctatccaaactgtactcatcctgctccatcatgaattctaatggcaccctctcattttatacaacagtacctataacaatacttacctagttgtatgcttatttgtatgtgtattgcttgtttatttgtgaagcccaactacactgtaagattcatgggggcagagaccatgtctgcctcattcaccattgaatacattgcacttaacccagttccttacacggagtaagaaatagaaaaattttttaaaggacaaatcaaaataatctgacaatcaatataatccataataaattctcaatatttggctacaatcataaactcagccaatgtacttttacatttcatttgaacctcatatgtggcattgtgcaaataaatgacaacttgaagcattgggtaattaagactacaagttatagtacatgccttgtaggaatctaaagcactaagatgtatacatgtattttaaattttataggtgatataactgtgttcccacagattttaatgttttaaaaaatcttaattggcagtaattgcactatttacatgttaatgaacaacacctggccccagctgagtataaagaggctgacaatgattttctctcttctccctggcaaagaactaagcatatgcaattttaaagagacctgcctgccaggaataacacattcataattggtaggacaatatgaaattagtttgcatatttcaccattctcaaaaaaatgcataacatttttcatgtttaaaaaaagctttatgattcaaagaggaccttatttcctacacttggtgattattcacaatcattaaattattcctgtcaatgaatgtgccagaaactggctaaatggaagcccaagtggcctcctataataacggcccagttcctggcttaataccttgaaaaaactgagtttcctttgaagtcattcaaaatctataattaaatatgttaatttcctggttctactatcctatgatattctaaatcactgcagttttgattccatttccccctacaatcctaaaaccaatgaaaaggttttcaaaaatgacttccaataacaaaaatttcttccactaacaaagaacgaaaattcttcttcctaaattttgtatatcatcacctgtgaaccaacagacattaacaaggaccacaagaagatgaaaaaataagaaccaagttctccaattgtttgttttcctagaattatattttaccaatagatataacaaagtttgacactgctattctatttcgagatatagacaaaccaaccaacaagtagttattgagtgcttggtatcctcagtgttataagaggtgctttgtggagggaataatggatgtacaagtagaagaattcacataaagatgtttataatatagtttgcaattaaaaatacaaaaaaaaattgcaaaatggcattggtttttgtgacctagggagtattttcaattcagaggagagagagtgtattcaggcaagtcttcataaaaaaccctgtggagtgagggtgggagaaaaaaatttagtgtcttccatgtgttggtaaatatgctagctgctttatctcatttatcttactcaaagtcgcacaattactaagacctagtaagagctgggacaggaactcagatatgacaatatgtgtattgctctctcagctacatgctagccttgaaggatggcaaaaacagataaggtgagaagaataacatgagtaatgggaggaataattttgaaatgtgttgtgctgaggagattgctgcaatagcaaatacgttgaggagtcatagaaaataacaacaaataggcattaatagaagcaatatataatagttctaaccttgagagcctggaaaaaatttgaaattcataaagtagaaattcaagtcaaatgagttatgtggtaaaatgggcatactagtttttcagaggctgataagatttaaaaaagtgaaagaggaatgaagtatctatggactaagcctccagacctgccctggcaccagatgggaaagcatagcccttgtgcagtgaactcaatgtgtgtccctgctggatatctacagtggccgtgggccctggataaatgtcagtggcaagcaggcctcagcaaccatggggcttctgctgcaccccagcactgcccccaactcagccacagtactacaccgactacagtggtccctggcatagggcactcccctagcaccacaacggccacagccatgccaggcttagggaccaggccagagggcctgctggagtctccggaagggcttattatttaaaagcattcccaggcaaagccaatttaaaaaaactggaataagtaactatttcttcaaatatgcaaatatcaacatatggccacagagatcaagaacaatcagagaaacaagacattattagggagacaaaataaagtgccagtgactggccataaaaaaacagagatatacaaactacctggcaaagaattcaaaagaactattttaaggaagctcagccacattaaaaaaatacagataaataattaaaataaatgagaaaaactgtaaagtaaccagaataagaaatttaacaaagagatagaaataatttttaaagaatcaaagataaatcctggggctgaaaaatacaatgaaaaaaacgcaatagagaacatcaacaacagaattgatcatgctgaagaaataatatgtgaacttagattatttaagagtatctagtcaaaggagagaaaaaaagaattaaaaggaatgaagaatgtcaatgggatttatggaacagcattgtaaaagcaaatatttgattcattggattttaagatggagagaagaaagatagaagagtagaaagcttagagaaatgatagcagaaaaacgtccaaaccttgagaaagatgtacatccaggtacaggaaagtcaaaggtttccaatcagattcaatccaaataacactacctcatgacatataatcaaattgtcaaaaatcaaaaacagagagaatcctgaaagcagtaaaagaaaagaagcaaagaacaaataaggaagttccaatacacctagcagcaaacttgtttgcagaaacgttacaggctaggtgtgttagtccacttttgcattgctataaaggaacacttgagactccgtaatttataaagacaagcaatttaattagctcatggttttgcaggctctacaggaagcacggcatcagcatctacttctagtgagggcctcagaaagtttacaatcatggtagaaggcaaaggggaagccagggtattatgtggtgagagcaggagcaagggtgggggaggtaccattttctgtgttaaatctgttcttgcattgctataaagaaatacctgaggctaggtaatatataaagaaaagaggtttacttggctcatggttctgcaagctgtacaggaagtatggcagcagtatctgcttctggtgagggcctcaggaagtttacaatcatggcagaaggctaaggaggagctggtgtatcacatggtgagaacagaaacaagagagggcaggggaggtgtcacagtcttttaaacaatcagatcttacatgaactcagggcaagagctcattcattaccatgaggatggtgctaagtcattcatgagaaatataccaccatgatccaaataccttccaccaggccccacatccaacattggggattacatttcaacatgagatttggaggggacaaatatccaaattctatcaccaggagagagctgtatgatatatgcaaactgctgaagtaaaagaactgcaagccagcaagctgtcctttagtaatgaatgagaagtaaagactttaccagacaaattaaagcagagggagttcataaccaccagatcttgtttacaagaaatgctaaaaactaaaggaaaagaatgtcaatgaataacatgatatcatctgaaagtataaaacacactggtaaaagcaaatacagagtcaaattcagaataatctaaaactataatggtggtgagtaagtcacttatactttagtatgaaggttaaaagacaaaactattaaaataatagctacaataacctgttaagtggtatgcaatataaaaagatgtaaatggtgacattaaaaaatcaaaatgtggggggagtgcagtaaaagtgtagagtttttaaaaattgtcatcaaagttaagttgtgataagcttaaaataatctgttatgactgcaagatattttgtaagtatcatggtacccacacagcaaagacacacagtagatgcaaaaaaatacaaagtaaggaatcaaaatatatcactagagaaaatcacttacacacacacacacacacacacacacacacacacacacacagaggaaggaaggtaccaaagaatctacaaaactactagaaaacaattaacaaaatggcagcagtaagtcctcaccttgaatgtaaatggattaaattccttagtcaaaaaacagagtgtctcagtgaataaaaaacaacattcagctatatgctgcctacaagagacatatataatctataaggacacatatagactgaaagtgaagtggtagaaaaagatgctccatgcaaatgaaagccaaaacagagcaagaggagctataattacataagataaaatagacgttaaggaaaaactataaaaatagacaaagaagatcattatataaagataaaggggtcaatttagcaagaggatataacagttgtacatgtatgtgtacccaacatcagagcacctaaatataaaaggcaaatattagtagagctgaaggaagagatagactgcaatacaacaataataggagacttcaacactccactttcagcaatggacggatcaaccaggcagaaaatcaataaggaaacatcagacttaaactgcactctaggccaaatggacctaacggacatatttagaacatttcatctgacagaagcagaatgtgcattcttctcaacttcacatggaacattctcctggatagatatgttagatcataaaaccagtcaacaaatttaataagactgaaatcatatcaagtatctcttctgacctcaatggtataaaactagaaatgaatatcagaagagactttgcaaaattcacaaatacatggaaatcaagcaacatgctctggaataaccagtgggccaatgatgaaattaaaagggcaatttaaaattttcctgagacaaatgaaaatggaagcatgaaacatagcatgccaaaacctacagcatacggcaaaataatttctaagaggaaagtttatagcaattgataactacatcaaaaaagaagaaagatctcaaataaacagcctaatattgccttaaggaattggaaaaacaagaacaaactaagtccaaaattggcagaaggaagggaataataaagaactagcagaaataaaatagaaattataaaaacaactgaaaagatgaatgaaacagaggttttttttaaaagataaaatcaacgaacctttagctagactgagagaagactcaaacgaaaatcagacatgaaaaagacattacaactagtaacacagaaatacaaagtttcatgatatgattatgaacaattatatgtcaacatattggatagcctagaagaaacggatacactttttgatacattcaattcaattattcatgaataatgaagtcatagaaaatctaaaccgaccaatagaaagtaaggacattgattctgtaataaaaagtctcccatcacagaagaacccaggacctgatgggttcactacaaaaatcaaacaaggacacagcaaaaaagaaaactacagaccaatactccaggtgaacacagatgcaaaaatcctcaatgaaatactagcaaacctacttcaaaagcacattgaaaatgttatttaccatgatcaaggggattcatcacaggaatgaaaggatgattcaacttgtgcaaatcagttaaatttgatacattacattaagagaataaaggacaaaaacatatgataatttcaataaaagcagaaaaagcatttggcacatcctttcatgataaacaatttcaacaaattagggatagaaggaaagtacctgtattaatcctcacgctgctataaagacatacctgaaactgagtaatttataaagtaaagaggcttagaggcttaatcgactctgagttctgcatggctgggatggcctcaataaacttacaatcatggtagaaggtgaaggggaagcaaggcatatcttacatgacagcaggagagagagagagagagagagagagagagagagagaagcaggaagcaccagacacttatcaaaatgaccagatattgtgagaactctatcacaagaacagcaaaggagaagtctgcccccatgacccaatcatttcccaccagaccactgccccaacatgtggggattacaattcgaaatgagatttgggtggggacacacagccaaaccatttcagtacctcaacagaagaaagaccatatatgacaaactcacctttacatcatactcaatgcagaaaaattgaaatatcttcctatgagatctggaagaagacagggatgcccactctcatctcttctattcaacatagtactgaaaattctatccagaataattagacagtagaaataaataaaaggcatccaaattgaaaacaaagaagttatgttgttcctgtttgtagacatgatcttatatatagaaaatcctaaagccaccacctaaaagctgttagaacaaataaaggaattcagtaaagttgcaggataaaaaatcaacatacacaaatcagtagtgtttctccaacttaatgagttatctgaaagagaaagaaaaacaatcctgtctacaatagttacaaaaaaatacttagaaataaatttaaccaaggaggtgaaagatctccacaatgaaaactataaaaccttgatgaaagaaatggaagacacaaacaaatggaaagatagcctgtgtccatggattcaaagacttaatactttaaaatgtttattctacccaatgcgatatacagatccaatataattcctaccaaaatactaatgacattctttacagaaatagaaaaaaaattctaaaatgtatatggaatcacaaaagaccccaattagtcaaagcaatcttgagcaaaatgaacaaaactggagtcatcaccctacttgacttcaaaatatattacaaagttacagtaaccaaaacagctcagcaccagcaatttcaaaaagacacatagactaacataacagaatagagagcccagaaataaacccatggatttatagccaaatgatttttgacaaaggcaacaagggcacacaacggggaaaagacaatctcttcaataaagttgttaagaaatctggtatccacatgcagaggaatgaaattagggccttacctcataccatatagggaaataaattcaaagtggataaactataaaatgaccaggataaaacacagggaaaaatctccataatattggcttgggcaatgatttgacctcaaaagcacaggcaatcaaagcaataatagaaaaatgagattacatcaaactaaaaagcttctgcatagcaaaggaaccaatcaacagaatgaatatacaacctatagaatgggagaaaatatttgcaaattatagatctgataaggggttaatatctaaaatatctaagaaacacaaacaactcaatagcaagaaaacaaattacctgattaaaaaattggcaaaaggtctgaatcagtgtttctcaaaaagtcacacaaatggccaacaagtatatagcaagatgctgaacatcactaatcatcagggaaatgcaaattaaaaccacaatgagatatcacctcactcctgttatgatggctattataaaaaaagacaaaagataacgagtgttggcaaggacgtggagaaaagaaaaccctgacaaactattggtgtgaatgcaaattagtacagtcattatgaaaaccagtatggagatttctcaaaaaattaaaaataagactgtcatataatccagcaatcccactatggggtatatatccaagggaaataaaatcagtatggcaaagagatatctacactcccatgttcattgcagcactattcacaatagtcaagatatgaaatcaacctaagcgtacactaacagatgaattgataaagaaaatgtggcatatatacacaatagaatacaattaagccatgaaaaaggaaatcctgtcatttgagacaacatggatgagcctgcaggacattatgttaaacgaaatgtgtggaatctaaaaaagttgatctcatagaagtagagagtataatagaatgaagactaccaaagtctgtgaggttgagaatggtttttccagaagtgaaaattgtattttctgagcagatgttggtcaaaggataaaaacttacagttagataggaggaataagttcaagagatctattatgaagcatggtgattacagttaatgacagtatcttgtattcttgaaaaatgctaagagaatggatatggtgtttttaccacaaaaatgatgactatgtggggtaatgcatatgttaactagctagatttagccattccacaatgtgtatatccttcaaaatctcatgttgtacatgataaatataattttgtctgtcaatttgaaaataaatgaataataaaaatttgaacaagctaaaataagatagcatttaatgtatcattatgaataatttgttaaaatattgatatgtgtcaggaaagaaaagaaacaagtaatctcaattattgctaaatatgaagatttattttacattcctatagatccatgcaactctaacgtctatctagcaaatgtcatgaatttgtcagtatgattagtgatagtatcattatcacaaaacttgataactttttataaatcacttttgggaaaagactttcaaattgtttctacaaatcagaaacagagatcacaataaaaaaaatgctgaaggacttcattgatccttcttattctatttttacctttatatgaatagactgtggtaacaaggaaaaatgtttttccttcctcatatgccagttttccaagtatacaatgagcacatatataaaatcatctttagaattaaaaaatgtaaattaaaaatggaaatacatgatgtaagaaagtagtttggattaaaataagtaaaaccactagaactttctcaactacagcccaaatgagccagccaatttagaaattcttaaaaatagaacttttttttctttagatttcttgattaacaggtatagcttgctttttccaggaggggcatttttaaattacatggaacatttaaaaaaacaattatacacactcacacatacccacagaaatgataaaagacaaataacaaactgggaaaagtctttgtaaatcaaatcccaaataaatgactactactttacttaatatataaatagtatctacaaatcaataataaaagaccaacaatccaacatagtaagcaatctgaatgatttacagaaaatgtaatattactgacttttgaacatatgaaaaatggctgcctctccttcataataaaataaatgcaaaataaaaatacagcaatattggatttagtgtttatcagatgggcaggattaaaaagtttgataacaccttatgtttacaagtatttgaagaaacaagtactctcacaaactgataatgggaattccaatttatcaaacttctatggagggcaatttgacaatatttgtccaatatcattaatatttatcaaaataaaaaatgcacagatacctaggaagaaattccacttctagtaatttacatgtgtaaaggcacacacataaatatattaactacagtatgtttttgtaataacaaatcaatgaagccaacttaaatttccattgagaagtactggttaaatacattatagtacagttgtgcaactggaaactcagcagctgttaagtgacaaaatgcaagatgttgaatagtgaatacagtttgcttctatttgggcagaaaagaggcaaatatctgcatatgtgattgtatatttacagaatatctctctaaaggtactttagaaaccggagggagtggtggctttcagagaaactggggtgagggagatatttgcctttactgcatgccctctacattaggttgaactataaaaaaatgccaatatgcaacttttttgacataaaaaagcagcaattccatatggttcaaaaaataccagaataatttctaccacgtgcatgtgctacctattacaaaaaaaaagaagtgtcttaatgaaagctgcattgcatgagaatgattttattatttcttaacagaattagtatagtgtcatcaaatgaatttaagacctagtcaattgtatagatggctgaaggatagaatggccaagagggagacagcatagtttaccttttgggaggcagttgtagtgcagaagttaacagcttcatttctagagtcaggctgcctaggtctgaatccttgctatgtgaccttggacatgctaaataactataccccagtttcatctgcacaatgaagatagtgcctaacttactaggctatgttaggacaaaatagacataatggataatgtgtttggaacaatgcctgatacagagtgctccatgagtgttaactgctgttatcgtcatcaccattattattgctattgtttattattattaacatggcttattcacttcttaggggttcaaactcattttcacacttttgttctctcattttccttacagtagcccactacaactgtgcttgttttgggtctgattgtcctcagatccatgtccttagatcatatttctccttctctgctccttatcctagctccccattccaaggtttccatatcagctgactcttcccttgtccctccaccctagatgcattggtgttgctccctgttgttgcttatagttaggtggctgcaatgtcccatattcagcttctcagttcttccatggcctgcgtaaccaagttccattagtctccctgttttaatttatatttccactttcctggttagacctttactgatagagtagggtaaacacaaaggggtgtgataaaggaaaagggaggggcaggatatgattggccaggaataattccagttcctgacctgccttatttaacagccctttgggtataagctaaagctgaaagtagcctccaatgccaggtttgtggtaactaagtcctaacagtatttaacattttcactaaatcaaacaaacaagttatttctgtctagatggtgtatatccaatgttttcatcagtaaatgctgcaaactattaatttaaagtttagagttggcctaaacagtactgaaagcaaatgtaagcatcagtagtaatgcataatcaattgcatgtatttatgactgttccctcattatttcctaatgaggagttcaagaggctatgcatggctgtggatagctggtaggctactgcatcaatatcttgggtctgtcagagtcagctcagggttttagaaatgcttatttatatacttcatgaaaccaatgtgcataaaataaaaggtttattctctatttatcctctatcaaattatatgctgtagctcaattgcaaacatattataaaacaaaacaatggaagtcatagtgttcttcagcatccaaaagacaattttcagttttatggaataaaacattgcattaaagaagcttacctaaaaccaagacacaactgacttgctctgctaaaactagggagtttttttccaacattgatttcattatacaacaaattttaatgttctaattgggactttctaaaacactagacaatattaaattttaaataacgattgtcctttgaaatagttgccagaaaaattatgggcagaagcaaaacagattctatttttttctttaaaataccctcagtatgtatacagcatttcatattttagagtcaattttcaataataacagaatctctgttcattaaaaaagagtactttagttgaataaagaaaaaaaattaaacactgtactctagaaaataaagctgatttaaaacattgcgaatggttcagtgaaacagaattattgaatgaaacaatctgaagagactctgtaaatatttatttaaatattagatagaatagaaagacttctatgcaacaaaataaggtaaaatagctgagagaaggattcctctgtatgaaaaatggtatttgtttccaattttaagcagttttaaagaaagtttctttaggggttaagtagatttggaagtaagtaaaagaattttaaaatattgtaaaagtgtgttgatgaaaaagaattgggtttgaagtttgaaaatgaatagaaaacgtttgtgtttcttcttgaatattttggaaattatttgatttgtgaatatattcaagagatgatcacaaagataatcatatagctgccataaagacaaaatcaatcattgggcataaaatggtagttatatcagcatcactgggaagaaaggagatgataaaataggtgttgataaaacaaaatacacaaaataaacttttctcagaccaatttgcaaaaaaagtttgtaagaactacagatcattaaaaaataaatgcataatatgtatgaatgcatgtatgtgtatatgaatgcatgcatttgtgtgtgtactcacaccatattcaaagtatacaatagttcaacataggctaataaaatatctttaagcacttgcttttggaaatacagaagaatgactcataatttgcatgttatttatatgtaaatgagtgcttataaagtgtttgaaaacactttagtttctctcaaacattttatactctctggcatcttatttcatgtctgaatttgcttatcaatccacagcttaaacagaacaaggagatgcagcccagccactgtactcataatcataaataattaatggtttcagaattaatacattttcctgtagaaaacttataaaatggaccatttgctctaagattcaaaaaaattaccttagattagtattttatcattgtcattttctacaaatggaacaaagtacctttctaattaatcatttgtatacattccatataaaatctgccattttcctctttttatttttattattatttttaataatagcttaatttattttttcaaacaatgttcctatttctttttttaaaatttaaaaaaaattatactttaagttctggggtgcatgtgcagaacatgcagttttgttacataggtatatacgtgccatggtggtttgctgcacccatcaacctgtcatctacattaggtatttcttctaatgttattcctcccctagcctcccaacccccaacaggccccaatgtgtgatgttcccctccctgtgtccatgtgttctcattgttcaactcccacttatgagtgagaacatgcggtgtttggctttctgtacttgtgatagtttgctgagaatcatggtttccagcttcatccatgtccctgcaaaggacatgaactcatcattttttatggctgcatagtattccatggtgtatatgcgctacattttctttatccagtctattattgatggacatttgggttggttccaagtctttgctattgtgaatagtgccacaataaacatacgtgtgcatgtgtctttatagtaaaattaaaatttgccattttcaaacaatattcttttacttgtgcatcatatttcatgtattcctgaagcaagttatatatttttaagttgccttcagaccctatatcctgggattctcacagtagtggcagcagctatgtcagaggacccttacatacaggaccttattcaatcgccataggaaatcttatactaagtggttttacctccatttcacaggagaggaaactaaggctctgagatgttaagaaacttgcccaaattacacagcagttaaatgacagaacaaagattctaatgcagtcatttcctgcttcaaagccttcgctttctccactatgctctatttactggctctccataaaatatgtacaagggaatgagagagttggcagaggaaaacaagataatattaaagcttcaacaacataatcccacccatacccccaggaaagaagaaaagaaaagaaaaacaacttctagagaatgttatggcattatttatacatttagtctaatgtattatattacacattttctgtttaagatactgcataaaacaattgatgcttggagtttcatctggggccctgagaaaatcttcaatcagctatcctaaaattcaagaatgtcttctagattctatttactgaggcagggctgtcactgatttttttttttaattgcaattaaaaggattaaaatttaaaaaattgaaatgtaacgctctgttaaccagaaaattcaattaattagtatacttcatttcctgaaaactgatattagtgaaagctttatttagcttggctctttcacagatttgtactgaatgtgataatgcatgtaaagagcttagagcactgcctgactcatcagtttgtcaaactgttttccgtaactgttgttcactggttcatgtaacaaaagtttactaaatgcctactatgttccaggcaaaatgctatgtgctggagatagagtggtatataaaacaacattcctgcccttgcgaaatttatcttttggaggtataaatgtgaggcggtaatgcggttgctattttattgttattttcaaaatcattatcattgtcatcataattatttctcaataaaccaatgtccaaggatacaccatctctgaacttaataccatggctatatatatcttctctcactattaggaaaatctattatatggcaggacatacactctttataattctcctttagagaagttgtctctcttaatctctaaagcacctgaaaggatacctgaaaggatagtgaactaggattttcttgagattacagaacaggttacatgaactgttttatgtactgaaatgctaataaatgtttaaataataaacatttgtggtaggatttggtttgagattttctttgactataaccccatagtgagattttggagagagtcaccctcaaccaccgtaagacttctttggaggttaccattatttatcaaaaagaacctaagcattctgcatgataaaattggttcaggtcagtacacaacagaaagctgttgggttgtgtaacattaaacattaaaaacaaactaaacaatttgcctaagagcaagcatagtaaacccagagtaaggttattgcaagggtatgcaccccaggccaatgtcaggcaaaataagacaatgatgacatgattctggggagaaaatataaatttcatataatccaacaaagatttaaaagttcaaccacaaatttcagtgtaatttaaattgactatgtgttattattgacagcaaaatcaagaatggctagcatgaaaataattattgaaattcatctgaatttcaaaccatctgggtgcttgaataagtcctaaatttaaaaatattttcattgcacagtcttatgaaccaagtcacttaaaataagaggaagaacagaaagaaggtacaagaaattagtgagtttctattgcaccttaaaaattccaaagtgattttaccccatgaagtgactgtcctcattgattaaatgagaaaacttatgtgggagaggtttagtgacttggcctatcattggcagagtatagaccagaatctagaattggcactagatcatacggtctcagtggtgtgacatctacagtcttaaactctaattatttctttactacaaaattgtgcaaatcaaactttaccaatagtggctcttcctcaggcaagaggcaagagaacatacggcgtgagagggtgggggaaactgtttctggcctacataattgtaggaaacttcccttctttagctactgctaatcttagccctctctcactcatcagcaccacgaaattgtcaagctccaagatttttaattaatctgaatgatactgggctatatgactttaaaatattccagtaacatttcctttcctttccttttttttttttggagacagaatctccctctgtttccctggttggagcgcagtggcatgatctgggctcgctgcaacctctgcctcctgggttcaagtgattctcatgccccagcctccctagtagctgggatcataggtgtgtaccatcacgccaggctaatcttagtagagacagggtttcaccatgttggccaggctggtctagaactcctgacctcaagtgatccacctacctcggcctcccaaagcgctgggtgctgggattacaggagtgagctgccccgcctggctctgttcccttttcacgtatgggtcaatgtgtttttgtcctagtattttgccttaatttcagttctccaacatgcagcccatcattttcatttcaattcttcccggtctcagacaacccattttgcttccttactggcttttacttacacttttcagtaagtcatacattactttcatgtctttccttatacagttttatcttacctaaagtgaaagaaatccttcctcccagccgcccccccaccacagatcttccatttttattcatttcatttgggttctctccaattcaactgatgagtagagacagacatgaaaatagcatccaatttagatcttctggggatttttagtgagcaagtgggatctcacattttaccaagaatcacaaagtcccagcattagaagggtccttgaagttcattgaatgcaatcactcaaaaatcttatgtaatctttgtccattaaggcttgtcatcagtgagaatgtgaactcctcacacttgtactgtttagtctcagtactctgcattctctcaatgtaagtaagcattttatactatgtatatggttacatagttcaaataatcacataatctgttaggggccataatccacttaattgaactccctcatagtgcaggtgggtaaactaaggcctagagagaagaagaaacctactcagggtcacatattcagttggtgatatccttcctgagaaccagatcttctgccttgcaggccagttcttgccttctgatgtaacctacacttaacatattgccttaccagtattgcttccccttttgttaagtacatgttgtcttctattagatgaaggcaaaggttaaccaaaggctgagctcaatctcccttctttacgtaaccctccacagcatctaccacaagatctgggacagagcagtactttagaaaatttcataaatatgctcttatttccttctcctaattttcaaatttctcaacacattaagataaaacagacttaccaatgacttactaaatacttcccttgtcatttatcaatatcttgtacttatcatttagttgactatctcactaactccaagactgaattagcattgcaattaagattccataagacaggtgatcactacagagaggtggcttgtccttccatttctgagtcacaaataaatcactatgttaacaggatagagaatgaaaagttgcttaaaaatagacatttcttccaagcactcaaaatccccaattggtacaattcctgagcttgggtaagatgatatggcacttcagattaccatgaaaaattagaacgattagaaaaaatacacatcatgaaagctatactcttcccatgatattattacccatgtaattttctacaaaatagttcatgaaaagagaactattatttgaaatgttgaaatgaacttgctgaagaggttttcttctggcaaatgactctttaaaagcaaaagagaagaatttagtatagaataaaaccgttcaaccaatcttcccttgacactctattgtgagaaatattcttcagaagagcagagaattcagtgcaggtggaagcactggttctgtaattcacacttttatcacccatttcttcacagcctaggtcacttaaggacaaatatatgaactttaagaagctaagagagttttactcagtgatagctttagctaggctttgggaatggtttgaattctattccatgggaatagtgacaagaatatcttgggcttaagccacttgtacagtagaaaattcactgtttggggagatgaactagccatcacagattactagggtacaattatggcctgatgatagtaacaaattgttcaagaatgataataataatagctggggcagagactattagctatccaccaaaatctgttttctttttcttccttggtaatggagttatagaaatcacatgactgctcagccagagaacacactttccagccccagttcaggtaggcaactacgtgctcaccaatggaagccttaacacatcacaagtatactcctaacactttttcccctttctccttgctagaattaggatgtggtaggaatcgtttcaaatactcagatgataacaatggttttagaggatgatggaagaacatgaagagatgaatcctggtccctgcatagtgacagactgtgtgcagcagtgtctgctcacacctcatggactgttacatgaaacaatctttgttgtgtcatttcgttacagcaactaagctttttactctaacaaatgtagctaatgcttattatataccagagactgtttaaagagtttattacatgtgtctgttgcatccattcacttgtgccaaagtactccttgtactgtaggtcataactgaaatggaacttctccacaaatcctttccaatttaccttcaagcttccactgcacttgaacttatttgcccctttctcaaaggacttctgattttctaacctcatattataagccctgtttttatatatcttatttcttctagcagagcaagcttccagagagtaagttcatatcttattctcctgtgtaacctgtaaagtgctggtactgtgcctctctcaagaagtgcttattgaccgagcgaaggactgggacatttgagcttcatgctgtttgtctataatccagtgttgcagctgaataagcctggagcaagcacacatttgtcatgggcaacagaagcagaaaagaatctaggacccagaatcggtaacaggttgaatgcaaaaaacttttacctacaatcctgctatcttatgtcttatgtttccagaatttcatagtaaccaagaagatataggaaagtaatggatgatagctgaagagcttacattctacttatgaccaagtcctaactgggttgtgggaaaacgctcattggtaacaacttttgtcctcttgcaaagtcttgctagagtcaaatgctaataggctaagtactattttgagtctaacacctacactgttatactaagctgcttgcttttcttttacttgtcttcatatctcacaactattcctataatatggtagacatctacatgttatatttggtactaaagggcaataggcattggtaaaaacggaaattcaagtgaaattttcagagaaattaattagacggatgtgttataacagagtctggcatgaggcagtgatcatttgagtaaagctgatcctcaaataaattatgtagaaacaaataaatatactgacaaatttgcacatgggatcttgggctgggatttattattattttttgcatatcattctaaatcaatgtaaaataggaaaattggagcaaagcagactacttaagtttttttgtctttgtgttttgatatatcattatcattaacatttcttaattccttttgcccggcaaaggagaaaattaaaatacagaagtcgaaatactaaaaagtagcttttaactatggaccccaaaagagtagtatgtgagtatactactcttatagatttagtttttcctcgtgaaaaaaatttaaaatttacaaaagtaatataggtttcacacacaaatttagaaacaatattaaaatgctatactaaagataaaatttagaaacaatattaaaatgctatactaaagataaaattctgtaatgaatgaaaaaaaatcttgtcatccagaggtaacaatcataagcaatcataatcataacaattgagtggatattcttctcattgatttaaaacataactatgtttttcaagaaattatgatcatcacatagatactgttttattaccagcttttttccacttaacatatcatgaaaaacaccccatgccagttttctaaagcatttcagctaatactgcataatgctgtatggtataggtacaccatgatttatttaaccagacctacattataggacttccttcctttctttatttgtcttcatgccttcacatttatttcatttacatttaactgcacaaaatgttagggtgaaatagttatcaatatttaataaaatattttatgaggaatttgcttttttgacaaaatttttcctaaaaacttttaagagaaaattgcaaactccaaactgaaatcagtttgattaactgtctggtgacaggaaaggaaaaaaagaaaaataattgctgtttatttaactcagctgattaatggtaaatgaagcaaatgtcatggatctgtcagcatctatttttcttaactgctctattcactttacacattttctttatgcacttcatagacagccacaaaaagacaacactaagtgtggttagtagccacctgatggaaggaagaaccaaacagcttaagtaaaagaaggagtgccacatacatgcctgtactcaggcagtctgcgatgaaaagtgtgctatacctaattcccaataattttatgatctttgcatccagcttgagaggtaataacattttccattttacagattaaaacacatttagtttccaagatgttaaactgtctaagatcatatagctggtaaaaggcagcagcaaaattggaatcatgagtgtttggcttcaaaatctaaccactcttaaccactgcaaagttgttcttaccatgtccagataaaatcagaggaggatatcattttgaatattaaaaacacaatccatatactgtgtagtactactaatgtgcaatattacttcttaccttttcacactttaatgtcagattcatgttcctctttagggtgggatgttggccaacttgaggatttccagaaataaattaaccccacatcctaaatcttgccttaccaaaaataaaattttaaaaaggacagagatttcttcctcattacacaaaggtaacttacactgaagtaaaaatgatgaaatgggaacgtgacgagacacaggaaagtaaggaaaataacattatcttatatattgattttggattgtatgatattctattagtagaaatcaacaaatttctttttcatacataagctgactttcttttttttttttttttttttttttgacggagtctcactttgtcacccaggctagagtgcagtggtaagatctgcaacctccgcctcccgggttccagtgattctcccacctcagcaccccaagtagctgggattacaggcgcccagcaccactcccagttattttatatatataatatatatatttagtagagacagggtttcatcatgttggccaagctggtcttgaactcctgacctcaagtgatccacccgcttcagtctcccaaagtgctgggattacaggctggagccatcgtgcccagcttctttgtctccttttaggtggaaaactggataggacatatcaatttcaaaagatgtaaacaattcagatatgctacttctgcacattttaagttttaatcctgtgggctataatatccatgattgaaaataaagaaaagaagcaagcattaattatgcaaatgtttttccttttgattctttctaatccccaattaaccactctttgcatttaacttatatatgtttgcataatatactttaaaaatattatttcaaacatgcatcgatacttaataggtgattcttactgtaaagaaagggccttgtctccttcagaagggcctgtggtgtaggatgtagccgtcaggtgtgccattgagtttacattagtttgaaaattattcaaagaaagaaatggtaattatgctcaccaaattaacacagttaaaaaaataaaattcagtgctggtgaaagtgagtaataggtcctctcatacactatcggttgtaacataatttagttaagtttttctgtaaattaatttgaaaccatatagcagaaaatttttaaatgtctattctgtctgacctattattttactgctggaagctctactgctgaaataatttgaaatgtaggcaaagatacatgcaagaagtgctcaatgtagaattatttagagcctgggcacagtggctcaaaactgtaatcccagcactttgggaggcctaggtgggcagatcgcttgaacccaggagttcgagaccagcctgagcaacatggagaaacccgtctctattaaaaattgaaaaattagcctggcgtgttggcagacacctgtatttctagctactcaagaggctgaggtgagaaaatcacctgagccagggatatcaaggctatagtgagctgtgatggtgccactgcaatctagcctgggtaacagagtgagaccctgtctcaaaaaaaaaaaaaaattatttagagtgccaaaaaattgaagacaccctaaatatccactgttaggggaatatttaagtaaattatgagccataatagagtcattaaaatgatttccaaaaaattatttacagatgttagaacttacatgtggcaagtgttaaacgaaaggcaagatgtaacattacataaataatatgatccaaattatgtaaaaaattcagaaatctgcaagcaaataagccaaaatgttagcagttgttctttctgggttgtgacagaatagtttccccccttgcatttttatatttttctgtacttttgaaatgcacttgtctgtactttctacattttctaaaatgatcatctattttctcaaaaattaggaaaaataacatttaaaaatgacttgacatcaacagtttagaatctgagttttattaacaggaccaatatttgggaaggtcacactttttgctcacttcctcatcccttggttgtttcttccattactggtgtttaaaaaaaaatgtttctaatagcaaaaatgagtcagttctctccaaattacagattctttgcaagagtaaagcaagccaagaaagatgaacttgctaaaacttttaggcaggtttttaaatttttgtttgtttgttttttctgagacagagtcttgctctgttgcccaggctggagtgcagtggcgcgatctcagctcactgcagcctccgcctccctggttcaagcaattctcctgcctcagcctcctgagtagctgggattacaggagtgcaccactacacctggctaatttttgtatttttagtagagacggggtttcaccatgttggccaggctggtctcgaactcctgacctcatgatctgcccgcctcggcttcccaaagtgctgggattacaggcatgagtcactgcgcccagttggtttttaaaattttttatcaagcctacctggattactttcacttttctagctgagacatttgcaggtactcaataaggaagtgtaaatactgctcaagcagccccacaacaaaggggcttctcatgctaaacctggcagggagtgaaaatgcctttattttgcagtgaagtgaatctgaggaaatcctgtgtgaaaattttgcttgagggccctaaacaaaacacagatatttggcttctatccaaggtctgtgaccttccctgtggtcaaggttcacattattatttttttttatatggaggaagccctgaatatgggattgccaccaaagtcaataaaaatatcttctgcttttgaaagaagtgtcaatcggataagcagcgtgtacccttattattccaagaagagcatagttataatgccaagtcagagcttcatagctttactgcataaagaaattaacatacaacttaaaatacctttggcctgagttaactattcacaggttttccctctttaagaaaactcaatatatttaacacaggcttaaagaataaataaaaagaggtaaattattatttacactgcaggtcaatcctttatatgtatatatttcaacagaagacaacctttaaaatatgaagggccccagtgctacaattttcagatgacataaggaaagtagagaattaaaacttatgataaacaatcaggagtcatggccaatttaagagtaatcagaaagaaatgtaacagatgttaaaactgaatataaaaaaatttaaaaacaggttttaacaaacatttacagtttttcaacaatgttttcatttctaacagtaaatgatcttaatctagggttagtttcagaaataccacaatccttctgctctgatattaatacctaagtatttataatagtcataggatacatgagaatatcatcttattgaaacacatttctttacaattcttagatctatttggcacaagcacggataatagcagtgcccgctctatgctatactcctagtatagttgttattatattgttttagccacaactaaataaaacataaatttattttctagtgagcatttgcagtttatgagtcaagaactctctgagaagataatttcatgtactttccacctgcccttttatcaacattaaacaaacagtatgttttaccacaactcatttctgacattaacagttgcttttatttctctgccaacctcagccttgtcagcaggacttcagtgtgacagcaatggcagctcatgccaattagatccttttcaaataaatttctttttagcactgtacacatttgaatagatcaaaaaatgtaaaaaatcattattaaagcggctgagggcaaggaactaatccatcctgtatatgcctgtatctctccttatttaacaacactgacttccagctaaacacaagaaagaaagaaagaaaacaaaagaaagaaagatgcaaaatgcatcctgagtgtaagttctttggtagtttgaaacacaccactatatttatatgttctttggaaacgatattgatgattagagtatatttccaggacttgaattaataacaagtggtagaactcattttttcatgaattattatggaagtagtagatgggaaatttttgtcctgaggatttcacccacactcttcccacacacatatgtacaaatcctctaaaaaatggcttcaagaaagtctcccctctcttttatttaacaaggcagctatgcagcctgccatcctgggctaacagccagaagaagattatggcaaaaataatcacctttgcaacattaaggaaaacatgaaactggcactatgattcaggggcttatttctttccctctaaatatgataacacttttaaatttttatttgggaaatggttttctgcaagatgtatctaaaaaaaagagttgttttcttttcaacaaatagctagaggtgctgagagatttcctgttaaaactgtgtaaggcatttgactacttaaaagggaatttagtgctgatgaaagatgccagtttgacagtcacggaaaatgaaggaagcattctttattcccagagcacgtcatctcaaaatgaggaatcatctcttatggttaagagggtcacaccctattttttaatattcgttgggagtacacacatgctagatgatggaaagatacacatgaaacacactctgtgtcctctaagatattacattcttcaagccaccatattcctcatctcaggggcatagtatacatagactagtggcctctactttaaaagggaccaaggcaacaaaaggtagtgggtgagagattcaaatgaaggacaaaagagagcttagtttggacaacttcactatttcctgtaagtgttctcactctaaacttaaaagttagacctgcttaggctcttagttgtatgttatctgtatttataatctgtgggcaatattcatcacaaaccctatctacgtctaccccatccctcccaaaattaaaacatcttcataaatatttattcattgtgtgccttttgatagttcataaaacctgggaaaaattattcagcccccgtacctcaaacatagtactatcggtggcacttgggacacctgtgtagttaggtggtcccggcttagtgtaaactaagagtgggcatggggaaatataacatctcccaggggagtttatttgcattagttaattgaatagaaagtagcaggaagaggtgtttgaggacatgtgtcatatgcaaatttgtggtgggaaatgtgtggggctagaaatgaagaaataaggacgtggcttggcatgacacatgtcctctgcctggctccctgagtccatacattgataagtgcagctgacaaaggttgaaggagttcatgaagaaaggagcataagtggtgctgcttcagaaactgagcgaaaacatttgacacagaacaggggagaggggcagtctccccatttctgcctggtacatagtatggctctggcaacacagtgagaactgagaagcagtagcaacgtcgtgcattgagagatgggtggctttgggagtcctgaataggaaagggttcactcaaagagggtatcattagttatggcaatggccacctggatttcttgccatgtagtgatcatcaacataatttttagaatggaaatcatgaaaagattgatcttgaacatgtgagatacttggtgatctcagaaataattgggtcgactcaggttgcaagaggctgtgatcctgcaaattgcaggggaaagactgtttactgggatgctaggtaagtctgcgtgtgaactcatttgttcccaaattaatgaagggctatggtattcgtataatgaagaaaaaaaatcaaagctttttctaaacaggttgtggagcctatctaccaccattcccacctcttatacacacaaagatttttacaaagtttggacactgaactccacaaaacctctgcaggggggctaagagcatcacatatatgtcataagccactggagttccatgctggcttttgtttgcttatgttccacgtttttaggtattttcgtttttagctcctgggggtaatgggctgtgatgatttagtgcagggccagtccagagttgtttttgccttagtcaaggacaatttttgaagatctgcatttcccttgtctttttaccttatcccgaaagcaacactctcacgactttattttctgtgtcttgagtgctctatctctggagagtgtttctttagtttcacaacccactgcacccttcctctttccctagcctaaatttcttctcagggctcaaactaagagcttcctaggcatcctctctctctgaatctcttactcaaaagttctgaacaaaacctcgagcacctgaaagttcagctgatttaagggagctcattgtacaagcatcccacgggctgcactaaatattgaagcatgtatgtgtgtgatgagaaacggtactcaatgactcttgcaaatttggaagcggcttctttttcattattttattttattcattagcaaacagaagactgagactttaacaaactttgtaccagcaaaatggtgttatgtaaggaaattcactcactgtttatccaatggtccagagaaaaagcaagtttacagtctattaaggcatgatgaagaagaacttcggaattatctttaaaacagagtggtacttcaaggattctaaaccttggaagtactttaatagaggatctgctgctgtttccaaacaatgaaacccaaagttgacatcctgagaactaataacgtaacacgttactctcaaacttcaaatgtcctggcatttattgcattattaaaattgtgccctctgtgaagtcaactgagtatagtgtggacaaaaaaaaaagaaaacattaaaataggtcatggtatggcagcagtcaatgactttctaccctctccaaatatatgtttgtctcagagaaatatttcaccgactagcactttgtcacggggctcgcttctcattaccatttcaaatgtgctttctgtgctctgaggtacctctcggctgctctagggctttgccgagacactaaaaagtttagttgcagtgcataatatacaatgcaagttactagtatgaatttttaacagtgttttgttttatcacatcccagagtccctcgagatacaagaagtgggggaggccttatttatttatttatccctcctccccctcttttaatgcaactcttgccattgccgtgggtgtatgttcataacaaaaacttaaacaaaatttgggcaaatgaaaacatatgcatcttaaggcaattgtcaaaacaaaaataactgcctgtatgaaggctttagtagaggcaaaatgagataaataaatattgttaagggaatcataattatatctgaatagaccagtgttgtgtaatgttcaatatagtgtcagtttcttagccagcaaaagttagaggttagtctgatgaggtggttaagagcttgggctccagactcagactgccactgcctgtgtttgagtacaggctctgtaattcacttgctgtctgatcacccataaagtacttaagtcttctggctttggtttcttctttcataaaataggaataaaaacagtatctatctcatgtaaagattacaggaatttacatatagaaagccctttcttgagacagggtctggctctgtcacccaggctggagtgcagcagtctcggctcacagcagcctctacctcccgggctcaagcgatcctcccacctcagcctcctgagtagaaaggactatgggccttcattaccacgctgggctaatttttgtattttttgtaaagacggggttttgccatattgccctggctggtcttgaactttcgggctcaagagatcctcccgccttggcctcccaaagtgcagggattacaactgtgagccaccacagccagccagaaagcctttgaaacaatgtctagcaaatagtaagtatgcaataaaccttagatgttattattattggtcattagtcgatgtaagaggaaaacaaatggttgcgtgcattttgaccattaaggcacatctttttttaataaaaaataactaaaaagagccaaaggaaggttcaatggaaattatgtcctgtaatgacaggtggaaattaacaaaagccaacagctaaaagttaggtatgcagtataagttaaactgagagatttatacaggagaaagttgaacttctaaacataagctaaatcagttcaagaggtgtttactaacattctttaatgatggatctacaattggttatcaaatgatccctctagctctgtagaagcatttcgtggaaaatcaccaccatactttcaaaaagtttctgcccagaaagataatgagttgagtgaacaacaaggtaggttttgtgcagcaatgcttacgttctttgcaagatactggagccatagtgttaactgaacataatggactctgtagtccatttcagctttagcatcctatgattttttgactcattatatttctcatattttattacattacttgcatccttgaaatcgttcattagctttcagttagaacctacaaagagtaactcctaacctccaactgtctcattaaccttgcttagcttttcttttttccctagttctctacctcacagtcacagcttctcctcctatttctaaaccatatccccaaatataaataagtacacaaataatattgtatactttttctcttattactgagaaacaagccatttatatcactcttcaacttatcaggggctttggctgccactgaccactttatctgaagggaaattatgggagttactgtagattatgtcctttctatcaacccctgcatataagtggtcaccaatctcgtatatcggaccatcataatagcatgctaaatacacactcatgtcagggactgtgccacatcactgtagcctcaaggaagttaataacttgctaaagccacagagatagatagtaaatggtattgctggtgagaaaagaaaaacagctccgaccaatctgagctctgtgaggtctgcaggtccagaaagacataagtatgagacttcagtcatgccccccgccatgcctggggcaattgttgtcattttgtttctcactagctgcctcaaccaatatattcgtattcctggaattttgatgcaaagaaaaatatatagtcaatccatagtgtattttatgttattaaattaattaattaattttgagatggagtgctctgttgcccaggctggagagcagtggtgcgatctcagctcactgcaacctctgtctcctgagttcaagcaattctcctgcctcagccttccgagtagctaggattacaggtgcctgccaccacgcccggctaatttttgtaggtttagtagagatggggtttcgccacatggcccaggttagtctcaaactcctgagctcaaagtgatccacctgcctcggcctcccaaagtgctgggattacaggcatgagccactgcactggccagagtatgttattttaatataaattattggtaaacagctcaggaactgcctctactttccctttaaaaaaatccacttgtaactgctgctaaggggagtgtatattcagggcaacttggatctatgctcccaagtgcaaccctcaagcttggcccaaataaactctttactggcccaaaagaactctttactaatattaattttgcctcagctttttcattttaggtcaatactggaattaaaagttatttctgggagactctaaagttcatgctcacactggtgatgcagcttctcccccgtcatcttgtttcatcttccacaattttagtaaaccaatatttctcatttgagccaatgaaataacctcttaatcaactaccttgtctccagatttaaccattcctcaatcaatctttatttcaggatgctgttagatttagcttgctgaaatgcaaatgtaatcatgtcacttatatgctccccactgccttcagaagaaagtctgaattctacagataatataagagggcccttcataaagtggtctctgcctacttctctgccctcaactccccaacaggcacctttcactctggttaaactaaactagccttagtttcttcaataattccacgctctctcatgcctctgggtttttgcatatgtgattcccactgcctgaaaaggtcaacctcattttgtgacctggccaacttctgtctgtcctttaaaacttctcagcacacaggaggtactcagtagacatcttttgactaaaacatttataagactacctcctttgtaaaattaagggatagagatgaacatgggtaaatacagtaatctgatttgctaaaatgctataaaaagtacatttggggcttacgcttctagaaattgttttcccagccttgacctctcatctgtgaaatgctgcccagtgagcagatcataattatgaaatataatatttagatattaggcagtagaatccttgctgtattcattaaatatatattagttgatatttataaatgttttatatatgtattacaaaatgttaaaatacatttctgctctatgaatgaatttgttacaacgttaggttctagcttttattaacctcttaccctaagtgttaatatttcccatcctattgggagcaataggacacatttcccacattagcttctaagaggtcactgatttgttttcagtttgtctggtcactgagagttggcatagagttaccttcataaatgattcaagttaatgggaaatattaaaatgaaagaaattacagcaaaaacaggactccataagtgaaaaatgatcattggaatatcactccacaggggagtcatcccacttagctattcgttaaaagtagcttcaaggacatagggaagaggtgtagctgtttcaggcccaataggaatgcttttcgaggggatgaagttgggtttaaaatatgtaagggtgggctatggaaaggctcatgacagcattgccaataaaataattttccgtggaccacaggtggcttagtgatttttggcttaaggaataagcaggtgagaattaattacaatttcatgtcataccattaaagcatgttcaacataatttgataccaagaactgctgtctaaaatatgctatatcattccctatgtctacatcaattctatgggagagtacatatatgcatggatgagaaatatatttgttattatgcaggaaaataagtctacccccatttttaaagtaccatctatcttcccccactcccaggtccccttttgctgttagtgtctaaacctctctttgaagtaggagaagttgtttcctaacaactcttactttaaaaactttatatcttccttctcattctctcacctctttcttccttcctacactgctcacttaagtactctttaccagtctgaccactatcttttatctgtatattataggcaaaataaagtcttgattttttagaagggaaagtttacttgtacttttctacctcttgtatgtccaagacctagaaaatttataaagattgaaaatgcagtacaaccacctaaatattctataccagtgtcttatttgcctgactgctggtctgcctttctcatgagactagacagctcccgatagcgggatttaacattagtcctctgtgttttcactttctagaatcagaatcaaaacatgttaaagctggaagagcccttgcaaataactgaatctctacattcttagatgatgaaattgagattcagagaaacgaaattacctgcttaagaaaacaaacagcctccacatcatttcttggtttgctactacttgatctttgctttcctcccacggctttgtttttttgagtttggttctttactgtcgctctcacagtatatgttttggatcttggctctttatctggatttggactcttacactaccaatgtcagtttgttaaccccatgacttatgatgtcattcaggttatgttcctgggcttctcatctgcttcaagctggtataatctagattcttgtctgagccctgggttttgtcatccaactattacatacagatcttattttctctgtctcttttttcttttgagacagagtttcactcttgttgcccaggcaacagtgcaatggcatggtcttggctcactgcaacctgtgcctcccgggttcaagtgattctcctgcctcagcctcccaagtagctgggattacaggcatgcaccaccatgcccggctaatttctgtatttttagtagagacagggtttcaccaagttggtcaggctggtctcaaactcctaacttcaggtgatccacccgactcggcctcccaaagtgttgggattacaggtgtgagctacgacgcccagcctttttttctctatcattccctaatcagttagttcagtgacacagacttctagaaaacagagtttaaaaaatgacttctttcactttaaggcaattatgtctaaagaggtgaatatggcttcatcagcataggaaacaaaggcagaaatgttctctgtttggtgaaaatcagtgaagtgtaaaatggtttatgttcaaaccatataaacactgcctctaaacatttcatattaccatccatccaggaaccttaaacattgacatctgagtgaatgtgacatggcctcctccacatctaaaatgtccactgggcctatgggatgacgaaaaggaattactgaaactcacaaagatattgacaatgaaaaaatattttaaatgcagcactattttaattctaggttagacagaaaaaaaaaacaggtagaaagagttttgcaatattgcagagatagatgttacctgctgcctagttaggtgtaaaaaaccaaaactgcattgccaaacatttttcattttatgaacatgtattggaaaagcatcctccctaatcttattcacaaacagaaaatacattgctcgcacttaaagaaaatgaaatcaaacaggataaaacatgagcagagaggtttcagacatgtcccccaggcataccagctctcagacttgtgagaagagcagtcctctagctagacagagattcttccctcaactgggcagatgggcttgggaaacgcataagcaattagcttttctgctgaagcagaaagaagactaagaggaaaagaaatgtgtcccacatcagtatgatcccaaataaatcttatcttgccctgtaatcatagaaatgcagtgatatttttagaatttgggcttgagttttaacaagtgtggaagttatatggaagaaaggaagagcacaacaattatatttacagaaactatctgactttgcctattaataaggcataaaactcagttttccataatttgtttttattttgaaaactgaaataaaataaaaatattgaaatagattagaaaagataaagtgaaaaggcaagacacagactgagacaagatattttcaatgtatataactaaggatcaatatctgtaatatataaagaattcctatgagtcgattagaaaaataaaaactgctccaaagaaaatcaagaaaaggacaaagtgatgcaattaaaagaggaagagactccaatgtccaatactgaaaagatactcaatcccacctgttacgcaaggcagtacaaattaaaaccaccacacccattagactgaaagaaaataataactctgttaacaccaagtgacgtgttggtgatgatatgggaaaaaagtgttctctctctgtctctccctctctctctatatatacacatacacataaacacacatatatacacacatatacatatatgtatatgcatatatacacacacatatatatggatatacggaaatgaatacaattactttggaaggccatctggaatatctaatgtatttgaagataaaaaccgaattccacttccaggtatctatcccaaagaaactcccatttgtgtttatcaggaaataggcataaggaagttcattgaagccctgtttgtgtggttaaaaaaaagataatttgaatgtctctcagcagaggaaatagataatctgcggtttattcatacaatggaatattacacaggaacaaattatctagatctgcctttatcgacctgaaaaaaatctcaaaaacaaagctgtttgaaaaaatctatttgtaaaacatgtaaaatatttatgcaaattttaggagtaaaaagagttttagtaatttatagttatgggtacttacatatatagtaacattatactatacatgcaaggaatgatacaaactatatcgactttaggagagcagttaactctgggaaggaaagaaggaagtgaagttttacctaggtcttttaaattttctacctttgaaaagaaagagtgctatgaagcaaatgtggccaaatgttaatatgagtttaatattggttgtgtgcacataaatgccatattttctgcactgttcttgtatgtttaaaatgtttcatacagaaaaagtgtatgtgtgcgtgtgtgtgtttagaaaagactagggaaagaaaatggaatactcagtgtacaaaagggtgatgaaaagtccctgattaaacagaagtgtcatcattagctctgttcttctgatgaaaatgtttattagctagtcataaaagttactatattaagatgagggaaattaacgaagcattatctttacagtatttttttctaagtgaagtacatcaatggtcatttaggcatgaaccaaaaaaaagttattttaaatcgtctggtccctgtccttcagatgcaatcagcttcagttcattttgttaagtgattggaccttatctctttggtacatcacaaatgaaggagatcctgctgcttttagttttgcttatagtaaatccttgatggcttcacagctgagtgacaggagtggatagggcacaggattggatccttgagaattcaacctccggcaatgacttcttataagttggacatgtggcttgacttctctggacctctgttctttcgtctttcaaatgacgataataatattgaccaccaaatattatttgcacgtattttaagcaggatctgattaacctaacactacttttaaaatatacttcttttcttagatgcccaccattagataaattcaaggtgctacacaataagcttataataatgatgtcattggaacttataacatgagattctcttatgggcaaaaaccacttatataagttcttttgatacacccatcaactaaagtctcttgggagaggctcaagactgatctgcttcataatgaaaattctgaaagcataatataattttaaagtattgattatattttaagattgatcatcacctagcttggagcattagctattcaatttgcaatgagacttagtaataaacatggcagaaacattgggaaaaattcaatcatttatttcactttgagaatgactgctcaggtatctgagtacaaattatgggtacatattgtgttagatggttaattttagaaacagctcaagactaaccccttgagagcacatttacagataaatgcacaaaaaaataaagagaggaggctgcttatgcatagtttagaagctacatgaatctgcaaatgtacatagcacaacatctctgaaatgccttatgttccaaaaagctgctgatctgttttcgttaggttaatcagatcctgcttaaaatatgtgctaatcagtactcaactgcctagttggccaccttaggtgaagctctaggtgctcattactaatgaaagtttgccaaagaaaagcttaaaaatacccacatatataaatatatcattttataatatacattataattttacttagacattaatatgttacagcaaagttaatatgccattttacttttacatttcagttcaatttctctagcagaacaggaatgaagttagaacatgatttgctgtgcttatttcaaggtgatttacacttttctgttgatcaaaataggcacatagttgccatggaaaagatatttctatgcctaaaattaccttcagaaagtttgtacttgagggctcagaagagtaaaaccttgtcatgtaactcgatactttttactaaaacaacaggcaacaaaaatagtcagaaaacagtactctctaaacattaccttcagttgggtggaaaaagtgttttctcccccatgcctttctccttcagtggaaaacacacacacttagataaacacatcatcttttgtccttttggttaaagaaaggcaaaacagggagcaaatggatcagcaatagaatttaaactaaacctaaacccagctacaatacttagggagcttggattctgtaaatgaaagcaaggactcctgcaaaggcaaaaagatttcctcggcatgcaacatgtgttccctgttattaggaaaaagtggacaaaacaaggcgcagaggagtaccaatcatgcacaattgcttctgtactattcctggtaacctggggtttctcaaaagctctgcatgcacagcttagtttgtgacccatcttggctagcaggtgagtgttgtggctgcctctttctgtgaatgattaaaaaaaaaaaaaaaaaaggaatggacttggagataatttgatagacatggaatcagcataccacctactggtccttttacctgtggtcaatgttcactatgtctttatcacctcagatgctctcaaaccactgtccacttactaaacaggaaggcatgtgatgccagcatcatcttaacagaaatagaggcccctcctggggattatacgaattctggaagatctctaaacgaagactacaggacacattaagaacatgttgagtaactttgtctctcatgcataatcaccgtaggttggctttttttgtggtttttcaatagcaagttatgtttgtaattgaatggttggcctctagaaagtcgaattgattccctagaaatattccaaagtttgcagcatttaatctcatacttatagtgttaccaggactgggtataggcaaaatcatgacaagtctttcccttcattttcccttagttttctatgtctcttctggtatttcttcctcatcaccccttgggatttctgtgctctcagtctactgcctagaactccatattaccatggcccaatacctagtgtaccttctgatacaaagtatatgctcaataaatatttctgaaatgagtaaatgaacaaatgaaaaacccctgaagactgacagaattcctcagggctctgctaaatgacaggagaaatcagatgaattcctgtgcttgaaacaatcaaagtcaatatgcgcatgtcacccacctttactcacaagcagcaggttcctttgctgatgctctatttatgaaaaggaaaccaagctggaagttgaatgacaattccactgggccttagcttaggatgccacaagaaaacaccacagactgggtggcttaaataacagacatttactttctcaccgtttttgaggctggaagtctgacatcagggtaccaacatgatcaagttttttgtgtggggtctcttctggcatgcagatagccacctttttactgcgtattcacagggtggagagggagggagcaagctctctggtgtccctttttatagggatacgaattccatcatgagggccataccatcatgacctcatctaaacctaatgacttcccaaacaccccatctccaaataccatcacatgaagggttaggacttcaacatatgagttttgggagggacataatttagtccatagcatactggtttcatttttaagctaattaccaaggatttctagcccaaaggtcagagtacaaggggactatattcctctgcattgaactgtacagaagtccttgacattataccgttagtcattccattcatggtcccttagatcaaatgatgcgatttcctacatcatcctacctcttctctcaaatctcaggtcctttcatcaagcatgaacaaacccgcagtgatgaacgccttaaatgtactttctgctgtcattcagagtatcatttttgccttgtccgagcttgaatgcaagctgtaaaaagcgatcatgtactgggtatttttattggcacatcacccatgtttgaattagataatcaacagtgcacctgtaataaaaaattaaacttgttctctttaagcactgtttctttcaaaatgagatcctgtcattcaagatgcattattttccactttttcaaacccatgtcaacttcattaacctcctgagcagctttgccaagcattctgctcatctagagccacttgttgttactgctatttgcaatagcttcagtacttgagagtttacagaatgtgctgcttgccactctattcagagcctagaagtatattaactacagctgattcccgttgcctccccccctccctactcctttcaccagatcactcatttaagagatctgttcctcacctcaggaatcctccttagtggttctttagccagtttgaacaatgcatggagttgttcatttatgagtagaattaatacatttattcttcacgtatttcataaaatactgcaacagtccattgggaggaaatgcagagttttagcaccttttctttcccaggaaaattgctgttgttttaaaggaggggtccaaacttgtttgtgttcttcttcataaccccacagaattcctgatgcagatttcagctgggcttcactacctcttaaagagtatcatttggtgcttgtagttccattaactgaggggcctactttctttagtgttttcttcattttgtgtagtttaactgcgttgaggttttatattttatgttcctttcctccttctatgccgtaggaatgcaaggaacagatgcattcaatgattcattatcattaacagccagggtgaaatcaagaacttcatctacttctcggcttccttgttttgttcacaggggagccacattatgcatgagtggctcctctcaccctcctctctagatgcacactttatgtaagagactcatctttttctacttcagtgctgtgtggaatcgttagttagatacaggcaaagccactcctttagtgctttctctagagttgatggcactagatcttttttagccaagtagaaagcaattttcaagggcataaaaataagtgttttcctatttatagcacacaaactattgttaccttgtattccagtttatcatttccaatgtatttaattaatcaattccagaatctattgccaggcaaatagacacataatagacccaagtcattctcaagttcttataaatgcatgggctacagtctagagagctacatttgatccctaagaggaagttccccttccgtaacactgcctttggtgctcccagcagtagtctcttggtcttgatggactgtgtggttgacgggggtggtaatcatggtggaggggaaggggtgatcatatttttgtgctatgttttgagtgcttccagtagaagattatgtacattgatagctaatgataggtaaggcttttaaccacaggcccttccacagaactaatatttcatgttgagaaataatatgtcactgattgtggaaactcggcaaacatgaataaaagttgcactgaaggtaaaatatgctattcacctggttccctgaaaaagactgtcaactggtgttgtatttttagggacgtaccttcagttaagttgatgcagatggtatttattttaatatatttacatttcattctgtctccctgtcactcctgaccccctactgtttctcaaaatgaggtccatggaccacctacatcagaatcacttgtgaagcttgttaaaactacagattcatagacctatcacaggccatgtaatatacaatttctggggctgtggcctagagatttgtatgtataagaagcaccccaggtgactagtagggccattattactggagaatcactgcatccttggaggagatggggtaaaaacaaaagaaacacatttaattattctaaaatttaaaaattacatattctctaattttcaaaacacttagattaattttggacttgaggttctaaaaaagtaatgctatgccaaataaataaaaggtaattccctttcagtctttcacacttttaactaagacacatatccagcacagtgccagcattttttctagactgctgcttctcaaattttaatgtgcacacaaatcacctgggactcttgttaaaatcccgactttgattcagtaagtcttcagtgggccctagattttgtatttctaacaaggtctcagatgatacagatgctgctagtctgtggaccatcctttgagtaacaagatcatgtagcatgtaaggggactctttgggcttttaggttgtgtaaatttgcagaaactctgcaatatgtaatgtgtagtaacattattttctgcaaacaaaaagctgcattaaggtcctgtattccgagcatcagataagtcccttggttttgtctttctctaacacaagtaacctagagagacgtacattgccttgaatgccctgagtgattaaggattacaaaatatatataggaccttagagcaaagcaaggaaaatacaccaggacttacctccctcccactttttaagataaggtagggaaattacagggtgtgatggggcatgtacggaagcgggtagggtagatatcctagagaaaagtctggcaggctgggagggttatgggtgagtggatagggtgggggtcagggagaagagaggagagtacaatgttccaggcaccaggaacaggttatacaaaggcttagaagtaataaaagctttgcgtgaatatgcacctggccaaattgtagccttcatagagaatatatttaatttattcagatccagaggggaggctactatggaatttcaggcttcgtggcagtagtacaaatatttcttcttagggggagtggggtagttggaaggaggttaggaagagatatgccccacatcatgctaggtataagccttgcccatgatacaacgcagggaaaaaagtaacctttagtacttttgtcctgctaggaaattgctgacctgcttttctttgattgggaagaaaaacgacatcggtgggtgtcaagcagcaggtggtgaccactgtttctttaaagacaacatatgaaacactgaaaatttatttcccaataaacttgactttctgagctgaaccgcaaaaaaactgccatataataaaaggataaggaacaaggatatttccaattgccattaaatataatccaagtgaagtgattcaccgtggctcaggtgcaggttccccatcaatacaatttataagggttcagcttccaaaactacacttccatttgacagtaatttccttttttattttgttttgttttaagttgactacaattttcaatcacagttatcagttcatcacctggatgaaggtgacccagcagtccttctttatctaattcctgagatgtccttagattatctttcacaagcaaaattaacaatgataacaggaaaaataaattaattcaaagatgaagctttatcaaatgccatcttctgagggctgcattttttttcattaaacatgattcaaataatcttttgaaaaaagagatctggttatccagaattatcttcttccccactgcatgactaattccacaatcttaataagtttttaatgatgagttttataaataaagctgccatcagtttgccagccaagtgtattctttcaatatttttgagatacatgtgtatttttaagaggaattaaaattttcatcaaattaattaaaaggaacgatataacattagcacggtaaacactgaaataagtattttacagctaagtaatgctaatgctaggaatgatatctcttaaatttacatttctttatgtgtggaaatgtcagtgagagttttaagagaaaagagttctcaatacaaataaatttggagaactttgtgttgaacatatctgtacaggtttctttattaaaggacttctcagagcctttaaatatgctagtatgtactctcagtcaccaagagtgggctgtggtaatcagcacttcctgaatatatgggctattttgctttggagtctagtacaaaactagggcttcactataacatattttgggaaattataacatatttgaaataataatttacttctaaacgtaagaaataatataaatcttgtttaatcattccctttaaaaattgcttgtgtacaaaataccttcgaatctttcaaaacactactgatgttctataatcagcaactttcagcagtggcagtgtagtgtgtctgtaacttctgtattggacatgcaattcagggtgattaaaccaattggtctaagccaagattaccactttacatgatcgatccataaattgtagacataattaattgaatgtgtgtgtgtgtgtgcaaaacagaaagcatggagtaaggtctatcttcttgttgtcttcctctcatgtattctcattcaaaagagaataaataaatgggagtactcagaatatatctgtcagaaattggataaaactgagtatttctgcagcatttgtaattactttcagaagactggacaagaaatgcaagtctccacaaatcacaatggttaggattgagccttaagattctgagtaggctttgtaatcagcaaattgaagaatctccatgcagctccagcagtggcattctacaaaatatcctttggcattattatatattatcaagacaattgtatttctttggcaggggtatgaatggtgacttattttatgacagctatcagcgggctttttagtaatctgatagataacctagtttacagacctattttacttgttttaaggggtctctaatcatgtaatcacaggtgctttggaaatggctttgaagaaggactcttagagctgttgagttaataacacgcattatcaacattccctgctatatttttatacttctaaaatgttcactctctaaatgagctattctcattctctctttcttcctccctccccacacatgcaggtatgtgtgcataatgtgggctaaatctgaatgactactctaatttatacatctcttgatatcatacagccttggaagtagtttccaaattttttagtgtatctaaattttctgtggtcagccaaatggatactgcccctgtcaatagtttccagggatctttcactcctactcatccccatctgcaacgacctctattgcacctcctatcacgttcctaagagtaacacattgctgattttggaaaagaccttaatgtggacaaaaatgagactcttgaataaacactgttgctaggattgtaaatgtatctggtctttttggaggacattttaccagtatttaaatatcagatagcttccattgttttcctgtcaaaaattaaatgtgtataccctttgacccatcaattccatttctagggaatctattactgcaggataattcccacaggtacataaatatgtacatacatagaattcattgtagtgttgctcataaaagtaaaaaatgggaaatctcctaattgctcacacatagtaaaaaaaaatcaagcaacagaggcagatctatctatactgtcatagatattcaagaaacattgtttaaaaaagaataaagcaagttacagaacgcacatataacatgatctcatttatgttttaaaaatattacagaagaataagtatcaaactatcatccttgagcacctctggataggggaaggggtaaaggtaaggaggaggtgcagaataaattactttttcattttatattgttgtatggtttaatttttcttgttttacaaaaagaatataatcatgtgttacttacgtaattaatatttttaaagtaaaattatccttcaataatctccaaaatattagtttcaagagtcatagattcaggaaaaagaaacatgaggtatttgcatgttgaattaggcatgttaaactattatcaagggatactacccattatttctcttaagacttaggccagtgaattgtctattatttctttgagtattgtggcacaaagaccctaagatggccaccatatttatgccattttataatcccctcccttttagtttgagtacaacctgtaacttcattataatcaatagaatacagcaaaggtggtgggatatcactctcacaattatattaccatatacatataggactcattttactagtatgtagtaaaattctgcctctctctttctttttttctctctctctctctctctgttgctggcttagacaaagctgccatgctgtgagtagacctatggaaagggccacgtgacaaaaactggagaacagtctctagtagttgagagtgacccctggctgacagccaacaagaaaatagaaacttcagtcctataatcaagggaactgaattctgccaagaagagcatcatcagatgagacctcagtcccagctggcatcatgatttcagtccagtgagaccctgagcagaggacccagtagatgtgtccagacttctgattcatagcaactgtgagataataaattgctgttttaagtccttaagtttgtgataattttttacacggcagtgaaaaactaatacaagtaccttgttctaatattctgtctgatgtcatactaaccagtggaagataagagaaagcactcaatcagctattttgtttactactttctgatactaaactaccaccaaatgcagacacctgaactctataaatcactttctatatgttaggcatcatcctatacatttacagttcttactcacacaacttatcctcacactactcctgtgaagtggccatagattaggatattgtggctttaagagggtacaaaatttgcccaaggtggcaaggctggtagtcagctataccaggatttatacccaaagcctgtgtttaatgggataaaaaagactgaaaaagaaacaatccaatattttaaatcccacttccctttcagaaaatacttcaaaaatatagtagatctaattctacctcttttcccccaaatctgttacattttccagccctcattttcagtgacttaaaataaaaacccagttcagagttattatgctagagcctcactacaatgtggctcattatcacacagctttatatattctgccattcacataatttcctttttgatttatacctgaataaggtagtggctggaaacccatgttataggtagttctgttccttaatatgagaagattggtgactttttaagttcatacaggctttctattaaggaagtaaactctacaaaactaaaaagccaggagcacagagccgcacactaggatatggcactatcaatgtaatcatcaataggcaggttgagataaacatcatactgacaggatatgtgctgaagaaggccagaggaggaatgactcgattttatttttcccatgggcaaaggcagaaacggtgtcatgatgaacaaattaaagtcctaccacaaagcatttgtacaatgtgccatgccagaaagcaaagggcaaaccactaatctcagcggataataattagaaaaaacacaatagaagaaaaaaaaacaagaatactaggatgaatggatgttaggaaatatcactatcaattgtgatgactcttctagaatatgcattttgaccgattttatagagtgtgatttttctaaccacaggcatttagaattggcattcaaacactatgagagccaagtttaattaacttaaacttctgaataaagagacagccagagagcaagaagaacttccaatgctatagctacaatttgctgcaatttgctgttcaaactgcagaatcatatgcactgctgtttttattgcctcttcactttatcagccaaaaattgttgacacatcaacaaaacgatctctgtgatcaaagttttatcccatctatgactttctctcttcttttctgttttcctgtctgaatcagtacaatatctaatttggcccctgagatcagagactgaggtcaagaggaaaatcttgacctttataaatcactctctgtatgttgggcactgccctatgcatttacatcccttatctcagtccttatttacagggctccaggagaagtcctttgaatgatataggataatacaagagtataaatcagattattcttgaggaattagaaaactttcagtttagacttggtaattttaggataagaatgggtagaaaagaaaagtatctaaggggcatgtatgtgcatatgcatataaatacacaacacaatagcaaacttatgacatttaggaaatccacaatcaagctcaaatctccctgtcccaatgtccatctcactattctacttgagctatcttttcatattggctcagagcataatcctcaagtgaaatactgggtccttgcttcttgacttatccaaaaaccatttaaccttgagagctgcttcctctgtgcagccttccctgatgatccaaccccatgaagtaatcctgattgcttccatttctccattcacagtccatttctatcatatgatcatcatatcataccttgcactatttactcttttaagtaagtgtgctatctccttagctagactatcttaattacttgagggctgggagctcacagttcagtgaaaagataaacatgccaacaaagtttttgaaacacaatgtaaatatgtttttttcatagagataaacgatacagaatgctctaaggtaaaaaaccaaggtgacttaccttgtgagatttagagatctacagaggagctgctatctgaactggctattgaatagtgcttagaagtttgccagatacaaaggaaagaaattgacattctgggtaaaagaagctgtcggtctggagttgagaaagtgtgtggtgtagttggagaaaaatgaataaagttacctgtagagttttaagatgttggaaaggtaggttgaagctaggctttatggagtaaaaagtttatctgagagtacaaaggatagtcgttgagtttcaagaggggacaagtatggaaagatttgcattggctaaggtatttatggtgacagtataaaagcttgattggatttgggcaggactgaaggtagaaaaaaaatcaggtaactattattatatcacatgtgaaaaattatgagggctggaggtaaggcagaggtgaagaagatggagaaaaaggaatatgttagaaatggaattaggaagtagagttattagaatttggaacagaattggaggcaggggagaagaagaagcctagaataaataaaaaaatgtatatatcttgagagactgagtagatgttgatgccattaactaaaacaaggcattcaggaagaagagagggtactgaattaatgctggttgtgttgagtttgaaaaacatacaagccatctagtagatatccaatatgcagttagaaacgttctggaaaaaagtagggactagaaatctagactgggaagccactggcagtgtttaaaaaacatagatacggatgatacttctcagaaaaagagtgcaaggaagaaaaggtccgaggacagatatctggtgaacactgatacctttcaagggtggaatgaagagaaaacatcagtgaaggagtctaaaaagactggatagcccagataaatcatttttcttaagggaacaattgtacaattacacaaacttctactaaaagtaggatgagacctaaaatgaggactggatttagccataatctcaacgatgatctttaggactgtaatagcctggtggaaatagaagtcaaattacatttaatttattcaacaaatactcattttgttcctgctatgtgtcaaacttcgttttagttgataagaattcaggcaaaatccttgccctatggagtttatattctattggagaaggcagataattaataagaaaaataagtcaaagcatgttagatattgacaagggctaaagagaaagttaaagcaagaaaagagaaaaggaagtaattgtgtggatacagtatctgaagctgtgattttaaataatgtgatcatggaaggcctcacagagtacgtcatatttgggcaaagggccggaaaaaaattagtagcaacccatgaaaactgaggactaaatggtaaatgaggaagtatttatgagggaatagagagattaataatgcaagcgagaaggcattgaaagtgtaagctccagaggaggtggggagtgtatgggatcaaaaacacagaatgagagttgacaatgaaaaggggaaaggacatttcttactgtgaaacatgtggtaagactaagtataaatagaggtatatttagtgtagggtggcagggaatagaggggacttcatgattgatggcctttatttttctatgaggtagaaagcaacattttctgctgtctgcgaaggtgtgcgtggagtaaatatttcagagacaatatcattagtgcagtaagaatggggaactagaatgggaactgacttaagaacaaaaatcgagacagctgggcagttttaagggcttggctgaagttggatattatgaatttgcactggcaccagtcaatcaggtatgtgattttctttggcagaagcagtataatgaaagaaagaagaagaaggaaaaatgaaagaaaacatcaaggaaagctgattaatggttgaggattggcaagatggtgcaactacaagagtgtcaatgagttcacggttgaaatagggtaagagagagagcctgaaaaggtttacgaaatagataggtagctagggaggtatgagggccttgatgagaccagaagtgattcagtgagagtgaaggagggggagaagaggaaatgaattgtggaaatggagtgaaggcaatgattattggccagagagaggtcaagaaactatgaagttagggtttcagatgagctgcctgtcagaaaatagaggcagataaaatggaaagaaataatggtatttgcaacaacttggatggagttggagaccattattctaagtgaagtaactcaggaatggaaaaccaaatatagtatgttctcacttataggtgggagctaagctatgaggattgaaaggcataagaatgatataatggactttggggactcaggggaaagggtaggaggtgggtgaaggataaaagacattgggtacagggtacactgctcaggtgacaggtgcaccaaaatctcagaaatcaccgctgaagaacttatccatgtaaccaaacaccacgtgttccctcaaaactactgaaattaaaaagaaagaaaatggaggcagattatttcagacagatatttttcctaacagaaaagtagatttatcagtccaaaccaaaaataaggatgagtataagtctagcacatatagtatcattcttttggcttaagaaacattaaaataccaattataaaaagtttactgcaacaggacaacagaaaatatatttcataaatactatctgggaaagaaatttcaaaatcttaagacataacttcaagtaaacacaatactctaaactgttgtttggaaaaatagtggaaaacatttaagtttaagtaaagattttcaaaatagaaaaatgcacttactccaggcaagtaggaaaaacttattcaataaacatgagttcaactgtactgcattaaactctgcctggtaggataatagaaaaatgtaaaattgaattggattaaaaattatctttttcgcaaatggacatgtaataaatattttatacttggagactgaatggtagccaacatcctctaaagaaaacaaaatcatttattcaagtccagtttatagtcttattacctatataattttcattattgttattttgagatgttctggcttaattaaagttattagtgcccgtgaataagtgcaagtgtatttggcatttcataggtctgtgatactttcatatgtttcgcatttgacaacagggatctaagcttttatgtatttactttcataagtcataattcttaattgaaataaggataagccttcactatagaagtatattctacacttttatttataatttttctgtcttttctcttttcttacctgatttgggaattatctatttacaaagtatatacacaaaaccaattttctgagccattattgggcatgacttaagtgtactactttgtgtgaaattctccacccacggcattaataatcccacacaaaaaagaccaaaatgaagtgcttgattgagcttttatgattaaccaggctggaaacatagacttaaaaaagaatagcatttgaataaataaaatagagatgtgtaacaagaaaggttctactactttcactttcttcctttttagggttccttgaatccttcattgtgtgtggttattgcttgatcttcattttgcaatctacaattaagttctctgaaagtgcagggtaacaggtaaagaggaaagaagcaaagttgaagtttctgcccgtctctataattcagtttggtgtttcctgtcaattgtacatcttggattcttctggaaatgacagccacaagtacaaaagagacaggaagattgtggaagtggaaaaataaagaaaagaggaaaggaagatttgtgtatagaaggtaggaagatactttggaggagttttcccaacttgtatgtgtttgtggagaagtgtgggaagagaaaaaggaagaaagtcagcaatgaagtcaccataggaagagaataagagtacccttctatttaggagttatgaaggagtgttgggtacggtggtgggagtttcagtttgtttttttttaataggtcaccaacacatgtaatattatcatattgtgtcctatagacacattttattcactggcatttcaattccgactgccaattttccttccttctagaatataagctgttaaagccaaatttagagaagtgagtcatatgagaaatgagtctgaactgtctttcatgttattctatcactctccatgggaatattttgcttatacttccttgggacttgtcattctagagaaatcatgtcaccttaaggcatcctttaaaatacagagggaaaggtccatttaagttatatacattagattaaaagaccttaaactattagatgaaaacattagatcaaaaaacttaaacattatattaaaatgccctaaattccttataatgccttatatttaagtggtacattttacattcctagtacaaaagaaatgttatgagtcataataggaaagttaattcccaagagaagggaataatattcatagcacagttactcttactgttctgaaggtaatgaactataccagtaattattcttttgcttctaaaggtcagtaggttaagaatggaggtgtcaacataggggctttttattattcaccaacatttgatgggtatcaaccaataaaataaaataccattctttagtcattgcctcagaaagatgagatgaatatttctggacacagaatgtgttctggtctctctcctataacagaacttcagatttgaaatctgaagtttacaaaatttcagatagtgacgtggtagtgggttgtgaaatcaatgtatgggtcatgtaatgtacatttaaaacaatagactataatatgacagggtagattggatagggtagaatagaacagaaaaggttaggatagactagaataggataggctatcacagtgcactgcatatagtaagcataaacactgttttgtgaaacttttgtttaatacatacacataaattatgtatgtactgggttgtgatgaaaaatgtatttcttatgagccctggccataaaaggtcggaagtcactgtcttatgagctgcctctacatctcacagatagtagagaaaaatttttcttaggaccacagatatgatcagattattttcatctgagggaaaaccacatttatcatattctcagtagaacatataattatcagcggggaaaaataatttttatccaagatgataaaaaaattgacaagatggaacattagaaaattaaaagaaaacaaatagaacactctctgtgaaatcagaagggcaaaagtggaaacaatccaaatgtccatcaactggtgaatgaacaaacaaatgtgatatctccacgcaatgagccattatctggcaattaaaaggaatttaactgatgtgttatgacatagacaaattttgaaaacatgcaaagcgataaaagccagacacaaattgacaaatattatatgatttaatttgtatgacatctccagaataggaaaatctgtagagacaaaatgtagattagtgctacttacagttgggggataaaggagtaggaagatgacagctgagtgtaaagggtttttgtgaggtgatgaagatgttctaaaattgattgtggtgatagttgcaccactctgtaaatataataaaaaccatttaattttacattttaaatgagtgaattgtatgatgtgtgaaatctatctcaataaagctgttaaaaaaaaaacccaaaaccagaagcaatcaaatatttaccttttcctagtcactcacaaatgaaagggtagtaactgatatacatactaatgcatgtgcatgtgtgtatacacatgcacaaatatagaagaaaataaagaaaaagacaaaatattcatatccatacttcaagataaaattcaaatattacattctctgtgaaatcctcctagatttctccagcttattttctttgtgcttctaatgcatgcattttacatacacctattacaaggcttactacattgcactataattatctatttatatgtctactcccttactctgcccactgattatgaacttctcaaggtcaaggaaaatgtctaattatttatttctggattcttagtcctttgacaaatgtttgtacaataaaaaattgtagttttgaaacaaattctaatacatgctaacagatgttttcactttaaattttagaaagcatttttttcgactttatatcttccagacccttcaaatgactttactcactgaatcaattctggacatgaataacgacttgaagaaatcatctgatgagcttgctcttatagaactcttccaccacttggcacttgctcactacctaactggcatttggtttctctcagtgtggtttatttcagtaatcttacctaatgaattggattgaccatgccatgatccaatcaaagccatggtgattggctgtcttgacaactgggaaaaaatattgatcttattctggtcaattggctgagttatatagagataggttaataatgtcatcagaattactcttatcagtatcattaagtccaagtaagcaagctgctaagctgtgagcacatctgtaatccttacattccccttatcttcccactgtctctctcctataaaagtgccttgttcacagaaggaatttttaaatgtttaataacctaaaaggtctcacaaaatggtaatgatatttcatacgatatctgaagcaaagcaaattcaaatatttcagttagttatttttaagtcatcaaatgattctttttttttttaacacactggcatatgaaacatgctgcacatttatacagggaaatcttgtcataatggcttgttctatagatgattaagactgcaacatttatatttaatagtcccaatcatatatttatgatgaattttgctattttagaaaatgttttccagaagaaattccttcctcttctgagtcagtggaactaagtttaaccgaatttcttagaaaaattcctcttttttgtaaatatgttaatcatttccaatttaatgtttttatcctttggctagaggtacctggtaatttaaatatttttggagtctagatgagcaattaaacattttaaggcttggatttgatatggggaagagtatgtagggaaacatttattgctatttagtatgtacactattctcaaaatgtgttaaaaatgtttgaggttggccaggcgcggtggctcaagcctgtaatcccagcactttgggaggccgaggcaggtggatcatgaggtcaggagttcaagaccagcctggccaagatggtgaaaccccatctctactaaaaactacaaaaattagccaggcacggtggcaggcgcctgtaatcccagctactcaggaggctgaggtaggagaatcacttgaacctgggtggcagaggttgcggtgagccaagatagtgccactgcactccagcctgggtgacagggtgagaccctgtctcaaaaaaaaaaaaaaaacaaaaagaaagtttgagtttatttctttattatcctgatgataactgtggaagtgtaatgacaatataataacattttaggttttgcaaaatacacgggatacatataaccagtaatttaagtcatattcataatgcagttccttgagaaaggatcctgcctggagcaagtgtttatggttttcttatgtccatatccctcttgggttaattaaaagtgctattttatcatatccaagttggaaaatgtgacatttaacatgaccaatttatttaacagaaaaagatgaacaaattgctgacctaatatttgtgagtcatatttcacatatttgtattacacacctatcacatggaataagagttgtttgatgaaacaaaaaccacaggaaattaggaaagaaataatgctaaatatttttccttcagtaaacacaaattccccctttcctataaatgaagtaagctttaactgaataagagagagagtccaccttaaataaacccaacaagcaaaaatctcgagttatgaaaatcgtgaaatttaggggcagggtaattattcacattataatgtgacaagattttctaaaagactcctctacatagtgacctcacacattaggtaaagctataaaattatttgcgtacaggactttaggaacataccccatgtatgtaatgagagacagctgaatctcaactgagcacttaacccacattcttataccagctggcaagttctcaaatgtacaatggaagagagtagtgctacggcattaaagttacaagacctgtaaccatattattggagagtgcttttctggagcaaaacaaaaattgaactggcataaagaaggagagagccagaacactgaagaacatgcagcagtcttttctcatccatatcaggatggtgtaataaattactctcttctctctcatgctgtcaggagaaaacgatgtttagattaaacctcgctaaggactaaaaggataatttgtcagtattttccagtttactaccaatgcagtattgatttgctagggtccttcttcctatgttatttacactaattcaatctggaacaactgaaacccaagttgttggaaagcaagatatttctttaaatctcccagacccaaggtataaagtacaaaaaaattattatttctagttcttgtgggtaaagaccaaccgcttcgttggaggcaagttattagagaaaaccacttttctcctgagatttaccttgggctaatttctttttataaaattatgattcttgggagaacgtgataaaaaaaaattctgaatgcctgcccaatttagcagactcgtgactctagttctaggcagctgcttagaaacgagaagtaaaacagaaacatcttgataaaccttcttgtggctgaagctgataaaaatgacagtattagtttgatatacaaatgacagagcttagggacaaaactacactgaggcacaagataaaattacttcccaaatccttacttctccctatgcaagttatacaaatgagcaaacagtatcctataacatccagaaataaaacaaaagcaactaaaggttaaaataatttatgtattgagggcgagtaaaaatatatatcaagtacttaatccatggagctagcattgtctgtctaccttccttatctttctgttttttggttgtttttgttttgttctgttatgttttgtttttgcttcctggggtacctaaatgtcagctgtggcattgttttgactgcaaataaatatgggaggactggtaaaaatgtcatgagtttatgggtttatgattcttttaaggctgaagtgctgaacttccatttgccacacttttcaacctctacagatatttcctcaaactccgacatgattcaggattagtaaaatctcactttaacaccttattctttcttattctagtcttactttaggtgtgactaccctatagatccacatttattaaaaactttgatgggattgattgatcattctaattggaatgctttctaaaaaatcaattgatgcattattggataaaatatgattatatcttcataaactaaaatttcaatagtttttactggaattactagggaatttagtcagatgacatattaatttaggcaatgtcttatatgaatcgacctatttgacaattttgatcaacttgcttattttcataaatcactcaaaacaatacatgcatgtgcttatttatttatttatttatggacattcaatcaattggtatttgctatttccttgtcttaaaatgaactatgctgagtataaagttcttctacaacactcatttgactaattgtgattgaatgtggttgtgtctacatgcattgatttggcatatcaattgcaactatttctccatgcacaagttagcttgaatatattaccataagggccagtatagtcatcataaactgaaacggaacaaatccaggaaaccagaaaataggtttcactgattcaactattaagagtttaaaaactactgacttcatcgagctgattgaccaagtctttcagaaaccaaactggcttacacatataaacaaagcctttaaaaatcaattgtgcaagaaatagggggaggatgtggaggaagcagaatagaaagttccacccattgccccgcaaaaggcaccaacttaacagctatctatgtagaaaaaacaccataagaaccaaaaatcaggtgagcactcatagtacctggttttaacttcatattgctgaaagcggcactgaagagatagaaaaaacagtcctgaattaccaatacccccctccccccattgcccgtggcagcagctgtgtggtgtagagagtatctctgggcgctgggggagggagaacacagcaattatgagacactgaactcagtgctgaactgtttgttagagcaaaaaggataaccggaccaaactcagcagacaaccacccatagagggagcatttaaaccagccctagccagggagggaatcactgatctcagaggtccaaacttgagtgggtacaaacctcaccactgagggctacagcattctgtgcctccaagtaaacctgaatgacaatctaggccataaggactgcaactcttagttgagtcctagtgctgaagtaggcctagagacagtggactgggaggggcatgtaacatacttgagacaccagctggggcagccaagggagtgttggcagcaaaactcccctaaccccaggctgcacagatcacagctccaaaagagaccccttccttctgcttgaggagaggagaggcaataatgaagaggcctttgtcttgcatcttgtataccagctcagccaaggcaggatagggctctggtcagagtcatgaggcccctgttccaggccctagcttccagatgacattactggacaaaccctgggccagaagggaacctgctgccttcaaggaaagcacccagtcctgccaacagtcatcacctgctaattgaagagcctttggaccccaaataaacagcaatgatacccatcaaaagccttgagtgagcctctgagacttgctggtttcaggtgagactcagcacatgatcagctgtggtggcaatggggcaaaacttctgcttgagaaaagcagagggaaaagcaaaggggacattttcttgcaccttatataccagtatggtgaagtggggctagaacaccaagcgggctcttggggtccccagttccaggatttgactattgaacagcatttctggacctgccctgggccagagaggagcccactgctctaaaggttgagttccaagccaggcagtattcacaaaaagctgatttaaaagaccctctgccttaaatgaacatcagcagtagtctggcagtactccctgtggcctggggtggcggtaactaccaggcgaggttcctctgtcttttgaaaggggaaagaagagtgggaaggactgtctctcgtgttctgagtaccagctcagctacaatacaatagaacgccaggtattcttcaaaggcttttttttacctctagtccctgactcctggacaacacttctggaccttgctgacctgaagggaaggacacagagctggctggcttagacaccagccaattgtagagcccccaggccttgagcaaacataggcagtagccagggaatggttaaagccagccttgggtaaaaccagtgttgtgctggcattaggtctgaaacagcacagtcatagtggtggtggccacagaggtgcctgtgtcactccattcccagctttatgtggttcagaacagagagatagactctgtttctttgagagaaagtaagggaacagaacaagaatctctgcgtgataatccagagaactctcccatatcttgtccaagaccatcaaagtggtacctctacgagtctgcaagaaccacagtattactgggcttagaatgccccctaaagcatatatcacaacacacaagtctttttaaatgtctggaaagccttcccaagaaggttggctacaaataaacccagacagtgaagactacaataaacacctaactcttcaatgcccagacaacgaagaatattgattagcatcaacactatctaggaaaacacggcctcaccaaatgaactacataaggtaccagagaccaatcttggagaaacacagatctgtgacctttcagacagaggatccaaaatagctgtgttgaggaaactcaaagaaattcaagataacaaaaagaaggaattcagaaatctatcagataaatttaacaaagagattggaataattcaatagagtcaagcagaaattctggagctgaaaaatgcaactgaaatactgaagaatgtatcagaatctaacagcagaacggatcaagcaaagaaagaactggtgaggttgaagacagtcttcttgaaaatacatagtcagaggaggcaaaaataacaagaacaaaaacaagaacaataaagcatgactacaggatctagaaaataaccttaaaggggcaaatctaagagttattggccttaaagaggaggtagagaaggacaaaggggtagaaagtttattcaaaggaataataacagagaacttcccaaacctagagaaacatatcaataatgaagtacaagaagattatagaacaccaagcagatttaaatcaaagaagactatttcaaggcatttattaataatacaactctcaaaggtcaagggaaaaaaaggatcctaaaagagaaaagagaaaagaaacatacaacatataatgaaactccaatatgtctggcagcagagttttcagtggaaattgtacaggtcaggagagaatggcatgacatgtttaaagtgctaaaggaaaaaaaagtttaccatagaatagtatattcagtaaaaatatccttcaagcacgaaggagaaacaaaggcttccccagactaacaaaacctgagggatttaatcaataccagacctgttctacaagaaatgctaaagggagtacttcaatcagaaagaagaggacattaatgagcaataatgacctgaaggcacaaatctcactggtaatagtaagtatacagaaaaacacaaaatatcgtaacactgtaactgtggtgtgtaaactactcttattctaagtagaaagactaaataatgaaccaataaaaagaataactacaacaactttttaagacatagtaagtacaataagatataaatagaaacaacaaaaagttaaaaagcagaggaacaagattaatgtgtagagtttttattatttttcattttgcttgtgtgtttatgcaaatagtgttgattgttatcaggttaaaataatgggttataaggtagtatttgcaagcctcatagtaacctcaaaccaaaaacatacaatgaatacacaaaaaatgaaaagcaagatagtaactcatatcaccagagaatatcatcttcactagaagaagacagaaaggaaagaagaaagagaagaccacttaacaactaaaagacaaataacaaaatggcaggagtaagtccttacttatcaataataactgaatgtaaatggactaaactctccaatcaaaagacacagactggctgaatgggtgaaaaaaatattgatctgttgcctacaataaaaacacctcacctgtaaagcacacatagactgaaaataaaggaatggaaaaagatattacatgccaatgaaaaccaaaaaaaagagcaggatttgcgatacttatatcagacaaaatagatttcaagacaaaaactataagaagagaaaagaaggtcactgtttaatgataaaggggtcaactcagcaggaggacataattttgaatacatatatgcagccaacactggagcacccagatatataaaacagatattgttggagctaaagagagagataggccccaatacaataatagctgcagacttcaacaccccactttcagcattggacagatcttccagacagaaaatcaacaaagaaacatcagacttaatctgcactatagaccacatggatgtaatagatatttacagaacatttcatccaagagctgcagaatacacattattttcctcagcacatggatcattctcaaggataggccatattttagttcacaaaacaagtcttcaaaacattcaaaaagttgaaataatatcaagcatcttctctaccacaatgggataaaactagaaattaataacaagaggaattttggaaactataaaaatacatagaaattaaacaatatgttcctgaatgaccagtgggtcaatggagaaattaataaagaaattaaaacatttcttgaaacaaataatgatggaaacacaacataccaaaacctatgggacacagcaaaagtagtactaagaaggaggtttatagctataatgcctacatcaaaaaagaggagaaacttcaaattaacaatctaaccatgcattttaaggaattagaaaagcaagagcaagccaaacccaaaatcagtagaagaaaagaaataataaagatcagagcatacatttcatttaatttcaatgaaactgaaatgaaaaacaatacaaaagattaatgaaacaaaagtttttttaagttaaacaagattgacagacaaagaaaaaaagagagacgatccaaataaataaaatcagaaatgaaaaaggacacgttacaacttatgctgcagaaaatcaaagtatcattagtgtaatatctgcaactatatgctaataaatcaaaaaaatctagaagaaatggacaaattcctagatacatataacctaccaagattgaactaggaaaaaatccaaaacctaaacagaccaataatgaataacaaaatggatgctgtaataaaaaatctcccagaaaagaaaagcctggtggtttcactgctgaattctaccaaacatttaaagaagaactaatatgaatcctactcaaactattccaaaaaatacaggaggagacaatacctccaaactcattctataggtccaatattaccctgataccaaaaccagataaagacatatcaaaaaaagaaaactataggccaatatttctgatgaatattgatgcaaaaatcttcaacaaaataatagcaaactgaattcaacagtatattataaagatcattcatcatgaccagagggatttatccctgagatgcaaggatggctcaccatacacaaatcaatcaatgtgatacatcatacaaacagaatgaagaataaaaaccatgtgatcatttcaattgatgctgaaaaagcatttgataaaattcaacaccacttcatgataaaaaccctgagaacactggggatagaagaaagatatcccaacattataaaagtcgtatttggcagacctgcagctggcatcatactaaatgcggaaaaactcaaagcctttcctttaagacctggaacgtgacaaatatgtccactgttaccactgttattcaacatagtattggaagtcctagctagagtaatcatataagagaatgatataaaggacacctaaattggaaaggacgaagtgaaattatcattgtttgcagatgatgtaatcttatttggaaaaacataaagactccacaagaaaactatcagaactgataaacaaattcagtaaagttgcaggatacaaaatcaacataaaaaatcagtagcacttctatatgccaacagtgaacattcctaaatagaaatcacaaagtaatcccatttacaatagccacacagaaaataaaatacccaggaattaatcaaagaagtgaaagatctctataatgaaaaactataaaacactgatgaaagaaattgaagaggacaccaaaaaatggaaaaatattccatgttcatggactggaggaaacaatattgttaaaatgaccatactatccaaagcaatctacagatttgatgcaatccctattaaaatcccaatgacattcttcacagaaacagaaaaaaaatcctaaaatttatatggaacgataaaagagccagaatagctaaagctatctaagcaaaaagaacaaaactggaggaataacattacctgacttcaaattatactacagagctatagtaaccaaaacagcatggcactggcataaaaacagacagatagacagtggaacagaatagagaacccagaaacaaatccacacacctacagtaaactcatttttgacaagggtgccagtaacatacactggggaaaggacaggcacgtcaataaatggtgctgggaaaactggatatccatatgcagaagaatgaaactagacccctatatcttgccatatacaaaaatgaaatcaaaatgaactaaagacttaaatctaagacctcagcctacgaaactactacaagaaaacattggggaaactctccaggatattactctgggcaaaaaatttcttaagcaatactccacaagcacaggcaaccacagcaaaaatgggaaaatgggatcacatcaagttaaaaagcttctgtacggtaaaagatacaatcaacaaagtgaagagacaacccacagaataggagaaaatatctgcaaactactaatctcccacaggattaataaccagaatatataagaagctcaaacaactctataagaaaaaacctaataatcctatcaaaacatgggcaaaagatttgaatagacatttctcaaacccagacatacaaatggcaagcaggcatatgaaaaggctcagtatcattaatcatcagagaaatgcaaattaaaactatagtaagatgtgatctcacccggctgggcgtggtggctcacgcctgtaatcccagcactttgggaggccgaggcaggtggatcacttgacgtcaggagctcgagaccagcctggccaacatggtgaaataccgtctctaccaaaaaaaaaaaaaaaaaaaaattagccaggcatggtgatgtgcacctgtaatcccaactactctagaagctgaggcataagaattgcttgaacctgggaggcggaggttgcagtgagccgagatcatgccactgcactccagcctgggccacagagcgagaccctgtttcaaggaaaaaaaaaaagatgattttaccctagcaaaaatggcttttatccaaaagagagacaataacaaatgctggtgagaatgtgcagaaaagggaatacttgcacactgtttgtgagaatgtaaaatagcacaaccactatggagaacagtttggagattcttcaaaaacctaaaaattgagctaccatatgatccagcaatcccactgatgggtatatattgtatagtatatagtagcagtatacccaaaataaaggaaatcattatatagaagagatagctgcatgcctgtgtttgttgcagcagtgtttacaataggtaaaattttgaagcaacctaagcgtctatcaactggtgaatgaataaataaaatgtggtaatatacaccatggagtactgttcagccataaaaaagaatgagatccagtcatttgcgacaacatggatggaactggagatcattatgttaagtgaaataagccagtcacagaaagacaagcattgcaacttctcacttgtttgtaggatctaaaaatcaaaataattgaactcgcagacacagagagtagatgaatggttatcagaagctgagaagggtagtagggggctgtggggggaggtgggggtggttaatgtatacaaaaaatagaaagaacaaatgagacctactatacgacagcacaacagggtgactatagtcaataataacttaattctacatgttaaaatagcttaagagtgtaattggagtgtttgtaactcaaaggataaatgcttgaggggatggataccccattctccatgatggacttatttcacattgcgtgcctgtatcaaaaaatctcatgtaccctctaaatatacacacctactatgtacccacaaaaattaaaaatactaattgtgcaagaaataatagttcatatcaatcaaaaccagttattcagttctgtgtaaagacatagacataaatcatataccaaaagttacattctatattcattctttcaaaagtacttgttgaacacctgctaagtcctagaaactattctagggcctttaaggacttcagtgaacaaaacacacaaggatcctagtcctcagaatttacaattaatgtagatggaaacagacaataaacaataagcatagtatataagtaaattatatagaggttcatacatgctatggaaataaagacaaggtagagcagggtaaaggtattaagagttcagggattatggtgcaaactgcagtagtgtgtagaatgggtcaaagtagacctcactgagaagcagacatttaagcaaaagcttgatggaggtgtaagagtgaaaacatgcaatacttggaggaagaagattccaagtagaggagtcagccacagtgaagtacctaaggcagaagtgtgcctcaagtattttttttttttggagattgacaaagatgtcagtaacaatgctgcagagttaagaaaaaatgtagaaggaggtgaggtaacaaggagctagatcatggagggtattttagatcactgtaaatattctactctgagtgaaatgagaagccatttgcaatatttttagcagagtcgactcatatattttgtctactcttttattatttttaaataattgacacattataattgcatgtttatggggtagtgtgatgtttcaatacatgcatattttatataatgatcaaatcaggatagttggcatgttcataatctcaaatctttatcttttttttgtggtgatatcttgcaagatcctctattctatttatcttgaaatatgcaatacatttttcttaaccagctatggtccctctactgtgcaagagaacaccagaatttatgtttcctatttaattgtaactttgtacccactgaccatcttctcccttttcccccttcctcctcccctgtttggtctttggtaaccactattccactttctacttctatgataccaatctgaaagaaaaggatgctaacctgtaataagaaaatattttaaaaagatcactctgagaagcatagagacctgttacaaggctgtatgatttaacccagatgagagatgatggtggcttggacaagggtggtagctgtggagctggaggtacagtgaacagagtttgctaatacagtggatgtaaggtattgcaaggaagagagctttcaggatgactccaaggtttttgacttgagcaagtggtaggatggagcttccgtcaactgaaatgggaagtctgcaagttttgggtaggagggaaagatcaggagtttagttttgggcaagttgagtttaagatatctattaaacatccaaatgaaattaccaaataagtaattgaaaatggatgtcagaagagaagtcttggctgagaaataaatttgagagtcattagtgtattagatggtttaagcctcaggactataagaggtcactgagtgggtataaatggtgaagacttgaagacaaaagctgagcactggtgtacaccaaattaaaaggttagagagtcaggcctgtaatcccagcactttgggaggctgaggcaggcgaatcatgatgtcaggaaatcgagaccatcctggccaccatggtgaaaccccgtctctactaaaaatacaaaaattagctgggtgtggtagtgtgtgcctgtaatcccagctactggggaggctgaggcaggagaatcgcttgaacccaggaggccgaggttgcagtgagcagagatcgtgccactgcactccagcctggcgacagagcgagactctgtctcaaaaaaaaaaaaaaaaaaaatagaaggaaggaaaagaatcagcaaataagacagagaagtgaccactgagataagaagaaaactgagagagcatgatatcctgtaagccaggtgaaaacagtgtagagaactcagaatttcttcatggaatgggatatgaccttagttttatactaattttgttttggtccatgtttagcactagtaacctgggattataaaacatgtggtataaggaaaattcttggattatttcacaaggctacaaattttcgcatggtaaaatggatcaaacaattacacagcatttttgtgcaggctacacaatctctccaacttcagaagaattatttcagcaaatataaactttgaaggaacaatgaaaatacgggacaattttttaccaacaaactaacttttcacttacaaacatcaaaataaatgaaaattatttaagcagaaatttccaattgaaaacaaaacgttaaaagtatcaactttggtgaataaggaaactctatttaaaatcaaccatttagcataatagtcatttgttcagggaaacacaatgatgtgtacactgctgaaattgttaaatgaaaaatacatgtttttggtttcaaaggaaaatagcatggtatatattaatatgaaaagtttgaaatttgcagctgtgttcttgttttacagctgctaattttggcaaacaattttgaaacataaaactgcttgtccactagataacaatacttccatgccttgcttcctctgtaagacagaaacttgatctccaaacatagttctttcaagcaaacaagaaagtatatcccctctatacatggggctgtaatttcattaggacaatcaatatgagcaggtgacataatagtaatgtaaagagcaaaatattatttgcagtataatagatttgtttcccactttattttcagaaggaatatacacatacaaagctacgttaaagaaattttaaatttctatttatgttaaatttaaaatttaaaacattggaaggagccctttaagcagcaagtattggctattttaaaaagtggccaagaaagcaggtgaattggattcattaatctatgacatcattttccttttattttgaaaaattatgttaaattaaaaaatttaatagcacattatcaaagtacaaacgggacaaaagagcatgcaggaaaaaaaaatctccctccaatccctgtcccacagccacttacttcctctccacaaatgcaatcaaaattattcatttattgtgaatattttcagagaaattctatgataatgtaagcatgcaagcatatagcttcattaaaaatcacacataaagtgtagcacagtggacatcatcattttcaaacttcaggttgtgatctattagttataaaatgaatttactggatcacaattaacattacatagatatgaaatggaatcgaatagaagagaaaatgtcagagcatgttgtttcatagtaagggtagatatcgtcttatgaaatttttgtttttgttctttatttatggattcattgtgaactgggttagaatgtaaaatatatttcttcaactgggtcatagacaagaaaatccactactatcgacaacgattcaaaccctgtggcttttgtttaatgatgcatcttgaagactgttcaacttcaataaatacagagttgtctcattttgtttgtgctagatttattttaaaaatttcagacacccataaaagggtataaagagcaatattataatcaccatgtaccccattactgagcttaagaaataaaatatcataaataaatacatatacaaatagtgtcaatggagttaaaaccccctgtgcaattccgcttgagccacccaacttttcttcctacttatatgtcttattctctttaaggctgcagagtattccactgcataaattactcaaattattataccataaattattcaagtggcttcctattgataaacatcttgattgatatcactgattttttgatatttcaaacagtgctaagtgaatatcttcatacataccactgcatgctcattcaatatctgtaggataaatttcaagaagagaaactgctggatcaaagaagataatttgtctttgctagatattgtcaaatatcttttcatatcgactgtatctatttttacttccataatcaatatttcatacacattttccaaaaatgtatgttataaaattttaattattgccaatattataggtgataaatgataaaatttagttcagttttaatatgcatttctcttaggagtgagtttaaacattttttttcatatgtccaagaaccattctcatttcctttactatggcatatatcaatttttttctattacattatttggatttttttcttattgattataagcactctttatataggaggaaattgactgtctctgtatgctacacatattttaatatacatatatatacatatgtatataattttgtgtagtcaaatttgacagcagttttatttatggcttctagttttttgggctatatctagaaaaggttttcctactttaaggttggaagaaattctcccatattgctttatagtacttattttcacatttaattttgggtcacctagaatttattctggtgtagggagtgaggtacggagggaagcaactttattgttttctgcatggctacataattgtctcaacacttttcataaacaatttatgccttccagacttatttgaaaggtcatctttatcatatactgtactcctgtttgtatttggaaccatttccagtcttcttccatcctaacactttgtttattcatataatagcaccccgctaatttatttacaatgaacttaaatatattttaatatctggcaaatctatcatcattatattatgtttttccccatatattttcaaagtattcttatgtttgtttttcccagttgaatattagagctggtatgttaggctttttataagaccaattgatattttgttattgaaggcatgttaaaatgatagattaaggggaatttttatggttctgagacttatttaagaaaaaagtatggctttctacttatttatgttcttttctatattcctcaatagcattatgatttttgtgtgtgtgtgttgtactttttgcttgtttattctcaggcattttgattgctgttgttgctactgtaatcatttattcaactatattttctaagtaagtattgtttgtatggaaggaaactattaatttggtgtgctaattttatacccaactagcttactaaattctcttatttcttgtattagtttcatgtttggtcttagattttttttttttagatatacaattatataacctaaaaataataaaattatacctcatttttctaattttattcctcttctattttctaatgtggacagttgctacttcataagtttaaagtagttaattagagcggatatccttgttttgttcttgtctctaatagaaatccttctagagccaggtgtggtggctcacaactgtaatcccagcactttgggaggccaaggtgggagaatggcttgagctcaggagctcaccagcctggtcaacaaaggggacatccattctctacaaaatttttttttaaacagccatggcatggtggcatacacctttagcctcagctactccggaggctaaagtgggaggatcacttgagcttaggaggtcaaagctgcagtgagccatgatctcatgactgtactccaacctgagaaactgagtgagactgtctcaaaaaaaaaaaaaaaaaaaatccttctagtgcttcctcacttcaaataaaactggattttgtgattttacatgatcttattctaagaaattatatatatatatatacgtttgtatgtatgtctatcaaaaattgatgcatgacagacagtataatatcatgggtaaatgcaaggattgaactgcctggtgtaaatactgactttaccacttaccagccaaatcattttatgtatccttattgtgccttagttttctcatcgtaaatgggaatatcatttgtacctcagttatggagcggttatgaatattaaactcaatatttgtaaaatacttagagcaatgtttggcacagaataaacacatttgttaaataaaatgttggtttttatcaaaacccttttgaaaatctccgccgtttttaaatttggtttatctacattgatgtactcatatggtatgttagagtaacagagtttttaatattgaataatccttgcattcttagtatgaactgcacttacttgtagtgtattatttttctgttatattgctggaccttgtgggctagtattttatttaagaattttgcttcggtattcagaagtaaaattgatttgaagatttatttcgtactttccttttttaacttttagatatcaattttttttgcttccaaaaaaatctttaaaagatttggaagctttcatttaattatgctgttaaaacatttaagtagcattgaaataatgtgttccttaaagatgtagcaaattttgcctgtgacactgcctaattacgctacttcttttggtttaagtagttctttggaagttttatttctattttacaaatcagatttctttctctactgagaaaattttctctcccttctgagaccagttttagtcatttgtattttttctatgagattatccattccaacatggttttcaagggtaccttaaaagaggtgcacaaattggtctcttatgaatcattcaatatcctctgtctctttagttatttcgacatactcacgtcttattttctcttcttttcctgattctgctattttactgcttatgcctataagaattggttcttgaatttattagttagttctcagattttatcatagtttccttaaaaaatcattccagttcaaacgaaaatttaaagtcattataaaaattgttaaattccagaatcaataaaggacatccagttaaaaaattataattatttattttgaaataggtgatcatacagaggaaaaaattccaaattatacaatatagcattcagagaaagaatatttgttcaattaacgcactgcagatcttcagatttccactttcctccacagaggtgaccatgttacccattcatagagacaaagtattaattgcagtggcagttgattttcatttgtaattttttggctgcagttggtaagtaatgatattctgctcttttaactttcaacccctgacttgaaagaggttaatcattttccattggttcctaacagtgcttatttttccaaaacaaaataaactctctctagaatataagttgtgacttctgaaagtgactggtacctcaaagcttggcccacatactcattcaaggaatttaagataatttgggggtatttggaggtagtcatggactactttataatctaatgaaggacatggatccttgccagaggactgcatatctatcagagtgcattcaatattacatgcaatttgaggcattcacagactctctgaaacccattcatagaacttcttggaactgatttatttataggtttattagtacagctgacgcttgagcagtgcaggggttagagatgccgactaccacacagtcagaaatccatgcataatttttgactccccaaaaacataactactagtggtctgctgttgagtggaagacttgccaataacaaacaattgattaacacatattttgtatgttatatgtattatatacttaattcttacaataaagtaagctagaaaaaagaaaatgttatcaagaaaatcataaggaagataaaatatatttactattaattaagtggaagtgaatcatcataaaggtcttcatcttcatcttcatgttgagtatgctgaggagaaagaggaggaactgatcttgctgtctcagggatggccaaggcagaagaaaatgtatgtataagtggacccctgtgcagttcaaaactttgttgttcaagggccaactatatgttcatgcttcacacatttaatgagtttttaccttgggccaaaatttctttacatacatctgtgatcagcttgttttatttcaatctagttgggggatacttacaattaaagcccagtgtgatgcagctatgacgaggctagtccagagaaccacagaactatagaggaggaacaatctcatccagaggtctgagggtggggatccagagtcaaactggagaactgatcatatagttttgcatatttgtcccctccaaatctcatgttaaaatgtgatccccagtgttggaggtggtgcctatagggaggtatttgggttatgagagtggatctctcacgaatggcttggtgccctcccggtggtcatgagttcacatgagatctggttattttaatgagccaggcatccctctcttactctcttctggcatgtgacactctagctccccttccactttgccatgactaaaagcttcctgaggcctcatgagaagccaagcagatgcagatgccatgcatgtacagcctgaagaaccatatgtcaaataaacctcttttctttgtaaattacccagcctcaggtatctttatagcaacaaaaacagacacacagacaaatataactgatttagatggggctagtgtcctaggtgcctaaccctacaagttgtcatcccctcatggccaaggatgagctgcagagtgaaggctggctcacggaagaccagaaacaactaaacaatctaagcctttctgtcctcttaaagtgttcctcaaggctgccaggcttgattaatatttttatagcttctgaattttcttctggatgacatttatttttttaaatgtttttattgagaaataaaattttcatatttatgggatacatgtgatatgttgttacatgcatagaatgtgcagtgatccaatcagtgtatttgggggtatccatcatgttgagtatttatcatttctatgtgttgggaacatttcaagtcctctcttccaggtattttgaaatatacaatacattgctgttaactgtaatcatcctactctgctattgaacattagaaatttttccttctatctaacagtatctttgtaaccgttaataaacctttcttgatctttccccatatctccttcccatcctctggtatctatcattctaaactccatctccatgagatcaacttttaaacctccacatatgggtgagaacatatatcattttttattctgtgtctggcttatttcacttagcataatgatgtccagttccatgttgctgcagatgacaggattttattctttttatggctgaataatattccatcatatatatgtaccacattttctttatccactcatccactgatggacacttaggttgattccacatcttggctattgtgaatagtgctgcaataatcatgggagtgcaggtgtccctttgatataccgatttcttttcctgtggataaatgcccaagagtgggaatgctggatcctatagtagttctatttttagtttgttgagaaatctccatattgctttcaatagtggttatactaattaacattcccaccaacagtgtgtaagagttcccttttctcctcgaccttgtcagcatctgctattttttgtctttttaataacagctgtgataagtgggataagattatatttcattttgatttgtatctacctgatgatatgtggatttatgtctgggttctctattcttttcaattggtctatgtgtctgtttttataccaataccatgctgttttggttactatggtcttgtaataaattttgaagtcaggaagtgtgatgcttccagctttgttctttttgctcaaacttgctttggctactcaggctttttttggttacttaagaattttaggattttttctatttctgtgaaaaatgacagtggcattttcataaggattgcattgaatctgtagattgtgttgggcactatattaattcttcctattcatgagcatcggatgtctttccacctgtttgtgtcctcttcaatttctttcatcagtgatttggtagttttcttggtagtggtctttcagtgccttggttcaatttatttctaggtacttatttttttggagctattgcaaatgaaattgttttcttgatttttcctcagctagttcattactgatgtataacaatgctactaatttttgcaaactgattctgtatcctgcaactttactgaatttatcaaatctaagagttttttgttgacgtcttaaggattttctaagtataagataatatcatctgcaaagacagaacatttgactacttctttttcaaattagatgccttttatttctttctcttgcctgattgttctggctaggacttccagtactatgataaacaggagtggtgaaactgggtatctttgtcttcttccagttcttaaagaaaaggctttcagcttttccctattcagtatgatgtcagctgtgggtctgtcatatataacctttattatgttgaggtgtgttccttctatgccttgttttttgagaggtttttaattttttatcatgaggggaatgttgaattttatcaaatgcttttctacatctattgagatgtccatatggtttttgtccttcattctgttgatgtgatgtattatgtttattgatttgcatatattgaaccatctttgcacctctgggataaatcccactgaatcatggtatattatgttttgatgtggtattagacttgttttgttgatgttttcttgatgatttttgcatgtatattcatcagggatattggcctatagctttctttttaaattgtgactttcgtggttttagtatcagggtaatgctggccttgtaggatgagttagggagaattccaccttcttcaactttttgaaatagtttgaggagaattggtgttagttcttagaaggttcggtaaaaattgtcagtgaaaccattctgtcctgaacttttctctgttgggaaacattttattactgattcaatctcattactcatttttgatctgttcaggttttctatattttcctgattcaatcttggtagggtgtatgtggccaggaatttatccatttcctcaacgttatccagtttgttagtgtatagttgttcatgacagtctctgatgaccttttgcatttctatgatatcagtttttgttatgtctcttttttcacttctggttttatttacttgggtctactctctttttttttggttaatggtttattgattttgtttatctgctgaacctacttttcatttgttgttcctttgtattactttttatagtccatatttcatttagttctgttctgatctttattattgtgttctttctactaatttggggtttagtatgttcttgcttttctaattctttggggtgcctgattaggttgtttgacatctttctacttttttgatgtgcgcatttttttcccataaacttccttcttaacactgcttttgctgtatcccatagtttttgttgttgttgttgttgttgttgttttgttttgttttttttttttagacagagttttgttctgtcacttaggctggagtgcaatggctcaatcttggctcattgcaacctctgcctcccaggttcaagcagttattctgcctcagtctctggagtagctgggattacaggcacctgccaccatgcccggctaatttttgtatttttagcagagacagggtttcactgtgtcggccaggctggcctcaaactccggacctcaggtgacccgcccacttcggcctcccgaagtgctgggattacaggtgtgaaccaccaagcccagcaaccccttaggttttgctatattgtgttttagttttcatttgtgtgaagagattttttaaaatttcctccttaatttcttgtttgactcaatggtcattaaggaggatatttaatttccatatatttgtacaatttccaaagttccttttgttactgatttctagtttaattccactgtagtataagaagatacttgatatgatgttgatttttaaaaacttgttgagtcgtgttttgtgtcctaacatgtggtctatcctggagaatgttacatgtgctgataagaagaatgtgtattctgtatctgttggatgaaatgttctgtagatgtctgttaggcctatttggtgtaaagggaagtttaagtcccatgtttctttgttaattttctctctagatgatctgtctaatgctgagagtggggtgtctaagtcaactattaacatatgtagtctatcaactattaatctatgtagtctatctcccttcttaggtctaataatatttgctttatacatctgagtgctttggtattggcggcatatatgtttagaattgttacataattctcgctaaagtgattgctttatcattatatgatgacatttttgtctatttttagtatttttgacataaatctattttctctgatatgagtaatgtgatgcctccagcttcattaggattgctttggctactctggctcttttttggttccatataaattttggcatagtttttttcctaattctgtgaaacatgtcattggtagtttgacaggaacagcactgaatctgtaaaactgctttgggcagtatggccattttaacaatattgattcttcctatccatgagcatggaacatttttccatttgtttgtgtcatctctgatttctttcagcagtgtttttaattctcattgtagagatctttcacctccttgtttagctgtattcctgggtttttaatttaatttaattttttgtctcactgaatttaatatcattattttcccaggatttcataaattattttttcattagaatctgttgatagataattattgtgttcttttgaggtatcatattttcttgctttttaatgtttcttttgtccttaacattgatatttgtgcatcaggtataacagttgctccttctaatttttttgtatttgctttggtaggggaggactttttcctgaacacatacctatatgttggttgggtagaaaatttttgctttgcttctgggtgccgtgccgtagtgtcatctctgtgtgactcctttagctgtaaacaacatcagtagtgtctatgatgtcctcagtggcttagtgtgcagtttttagtgaaggctaaagcaaagttttgctgcagatgaggatgccagctgggcccctccttgagctgcagtggtggcagtggcaggccaagtgtgcctgttcttgggcccattcaaggcagtgcatgctggcaccagtcttagtgggtccaggcaggttgatcattgggtttccagaaagcttgctcaagtgctggcaattgcagcagtggaccaagtgagtgggtgggcccttgggctgctggccagcaggtgtggcatggacagtagcagtagcagtgacaagacaaccttctattttccaagtgatctgtgcttgtgttggcagtggctgtggcaggttggacaggccaattcccaggtctgtaggtggtgcatgctgacgggtacaagctttggtggtatcaactggttgtgttggcccaacttgaggcttctgggaggagtgctcagttgtcaacactggtggactgagcaggcaatcctcactctcctggacaatgagcttggacactggtagtggtggtgctgggccaggcagatctgtattaagggcctcctcttgtggtgcatgcaggtgctgactgtggtcggcaggggtagggtgatcccagacctctggtggaatgcttgggtaggggtatcagtggctgcactgtgtccctgatatcagggagccacaggttgttttcagtggcagcagcaattgtcaggcaggtagggagtgtgcacttttgccctgggtagtagctacagcagggtagcctgtcattagggtgcttgcaaatgcaagaggctccactgctgggggcagtggggttgcttccaatggctcatactttgaccctggtagcagcagccagctgcggtggtggctgtaggcagaggatgttcattgtactccagggatgtgtagaggcagaggatgttgacccccagggcaggatgctgtctattggagaccgagctctcaaaatggtgtcatgctgtagctgtttaggatttgggggtgggtggggggtgagacccaatgtgacatctctctctggagcaatgccgtcacataatctccaggcatattccctatgttagtctcagggcccacatggatcaagggttctccatagctaggactgcaggagttcacagtgagactgctggggtctctcacttatcctttcatcatattggggatcttttccaggtccccagcccattccagctgagcaggctgccttgcttccctctttttccttgccttaggtacttcctgtcacttctttgctgaattctagcattctcccatagatgatgtatttgaagtgtgattactagctattttggttcttctttgtggaggaggtaagtaccagatgcctctagtcagctagcttcctttctctctctaatgacatgtaattttaaacaacatacagtcatgcatttcttaacgacacggatacaatttgagaaatgtgtcgttaggggattttgtcattgtgcaaacatcacagattgtacttacacaaacctggatggtatagcctactacacacctaggccataggtgtagcctattgttgctaggctacaaacctgtaagcatgttattaatacttcaccgaatattgtaggcaattataacacaatgctaagtatttatgcatctaaatatatctaaatgtagaaaaggtacagtaaaaatatggtattattatattatgggaccattctcatatatatggtctgtcattgaccaaaacactcttatacagcacatgactgtagttatatttttcacatttcaaattggtgaaaaatattttaaagtaaattatctagtatcagtgagggtacactaaaatggccactatcatgctttactaatgggggagtatgaatcttgatataatttgataatatatatcttgaactttaatgaaaatattttagaacccagtaattttatttgtagaactctactaataatgaatagatcagaaagagacctatctttgattacaaagatgtctattttagtctttttgctctagtgaaatactggaaatgttaatattcaaaaatagtgtatagttaattatgttacatctacctaattaatatatttaaaataacatttaattaagacttagtaatattggaaattgctcacattttaatttaagtgaaatatcaggttgtatggatcctgataaggacacatgatgcacggaaagaaaaaggtaagatgctaattcatgagagaatatgactaatattttattttggagagaaccttaaggattttttcctgtttttcagtaatttcccaattttctttaataatctatttattaaaaaatattacttttataacaaaaaaactactgaaaagatagtcaacttgcctctgaagtagccaagatgattccccttttctctaaagatattatttcaattatttcaaaaaatgatcaactaggatatatgaaaacaaattcaactgcacacattcaaattgtgagctattctgcattccactttaaatacctacccaaaaaattaactctgaccagcaatctcatgaatatctatcaaaagtgaaaagatggacagtgcaaggtaacacgaatgacttaacatgagcccattcccaaaccagaaaagaacaaccaaaagcataagtcctaactatggcaattgaaacattattttcaaattcagatgacaatgttgtcattttatttctggtgaatataggctcagccatatttttttccttcattttctaagctcttttttaaaactctgttgataagagcactttaactcattttggcttctttcacagtaatatactaaagaagtaagagagtaaataatatatcaagatcaactccaaagactaacttctaaaatactaattaattttaatagctacgttatttgtactgtatttaacttctacattcaagtttgctttcatgtaaatatatccatatgtatgtattatatattacacatatgcataccatacattcacatttattatttatgtgtagatatttatattctgtttttaaattaaatttttaagcaatttatttttcaaattgtggaaattatagtactgctagcaaaaacatatacatatatatatatatatatatatatatagagagagagagagagagagagagagagagagatccaccagctataaagtacaaatagttgacttttaccacttaaaaatgtaaatcttatcatatacacacacacacaacacacacacaatgcacctacttaaaaagacaaatatcacactaggaaaaatgcataatatgtagtgaaggtttttttttttttttttttttacccttaatataggaagtactctagagaactaataagaaaatataaaaattcatatgggaaagtgggcaaagtatgtcaacaggaaattgagagaagagatggaaatgggccattaacattaaaaagatgaccaaggtcacccataaatagaacaaataatagcaagaagaaatactgtatttcatattgcagattgggtattagaaatctttctcatcattgccagtgttgataagtatatgggaaaacaggcacttttatatagctttagtaggtaaataaattggtaggtcttttttaagggggaaatttggtaatatctaaacaaacattaaatgcatatattttcaacccatcatttctacttctaataaattatacaagaggtgtgtaaaagatgtgtacaaggatattaagtgcagcactgtttttaatatcaaaacactggaaatctagatgtccatcaacaagggactggctaaaaaaaataacacatatataaacagaatcctatgcagtcattaaaaatgacgaggcagatttgtactacaaatatggggaaatatccaagataatatgaactggaaaaaattatgagactttttgtagtatgtgatcccatttgtacatgcgtggaaaatttggggaattatatataatacattattaacctgactgtgtctcaagagtgaaacctgaaggatggagagggagggggatgatacactttattcactttaaacctgtttttactattaatttttaaatcactggccaatattactttaacataaagataatagtagctaaaattacctactgaaaaagaaaatatgagcttgttatatctaccttgataatggcttgaaattcagtatcatcaaagtggtttttaattttgaatatcacagtcaccacagaagtgtctcacccacacataaagtaatcccaatcacttccacacttcctctgatagtgtaacatctccaaaggagctgttacagagtcaactgcactgtctcacacacgcctaatgggtccaacagagccattaggatgtcagttatatggcagggctcctgctgaagctattaccaagtcattgcattgtttcatacacttcctttagcaatcagatggtttctgaggaattgttatcactgctatgtaagggtcctatataacttacactaccaggggaaaacaaaaaaaaagcaaaggaaagaaatggaaaacaaacaaacaaattccctccatcaaatgtacatggtcaaatatcagaagaaataactcatcatttgggtataactattacatgtcattcaagaaacccaggcattaggctagccatttttttcacaactccagcggtttccttgaatgaatttagggtctgagaacagcatatgcatggctatgatggtatgtttattggtagcacataccgcactacttaggttctgtggtatgcagtacagaagcaacagggagcagtactaatggatttcttggctgttatgagattgtatcagatattcccttacctgtaaagttgctgaacagaacaacatagggagctcagccgcccaacagtcaaggaaatcaacaggacttctgagtactaattaaaatcccacctctcccttaaagggttactacaatgacaacgggaaatacaacagcacaagttaacctgcagccaggtctgaagtgcctcagggaacttcctctcacagtcttctaagtttagcagaacaaggttgttgcctattaataaaatgttgtattatttaaaataagacaagtgcaaggatttttacctactttaaaatgagcagaaagtaggctgggttctgctaggctaaagagttccctgggatattaggtgtttcagaagctatgctgcctctttgtctaatacgtgataacaggtaccttacctgatagcatctgtcccataatacgtgcataataaattaatagtgataaacaacaaccacaactgacatttatagagcatttcattttaacagacacactgtaaagtgctatatatccattttctcatttaatcctcaccacaaaaactcccaagactttgcagtcaccatttgacagataaagaaactaagacttggagatctttagttacctgtccaaggacatatagcaggtaaatggcagaactagtgcaaaaacctaggtctgtcttacatcgtggttattcttaaccacttactatacagaaaacgttgtttatttatattgtattaatattaccacttttacgttactaaatggtttcacatcccttgtgctctcagagcaagctaccgtatctttatcatggtattaactaaagtgtattaaaattagctttcaatcctctctagtagacctctttgggtatacatatccatttgacactgacagccctgcattgggaattgcttcgagaatcaattgggtaggcttccagaaagcaacatttgtattactgaccttacccctcattgtagctgatgagaccagtggtagacagctgactcaagttgagaaaattattctgtctccttggaatttagaaatggcactaaaaaaaatctggttaatcttagcttctttcctgaatagaagaaatatgaactaaggttttatggggtatggggtttttatacctgtcctgtagatggaaacttagagaaactcaacctgcagagacagtgttgaaggagatgggtttcaaaacaaaaagcaaggtcttaacaattcttctgagaattgttaagggactgcaacaagtcccttcttgtggtatagccacactcttgccctgagtccaatggagcattctcacgtactttatttttttaaattgtatttcttgtgggtacctagtaggtatatatatttatggggtacatgagatgttttgatataggcctgcaatgcatattaatcacatcatataaaatgaggtatccatcctctcaagcatttatcctttgtattacaactgatcatatttcactattttagttatattaaaatgtacaatcagactattactgactacagtcaccttgtattcttatgtacttttaatacaattgttttcagtttaagctagctcaagttgattcctgttacccataataggcgatcttaactaatagggcatcaatctctcccagtagacggtaaattccttgacattggggaatgtgtgttattcatctttcatatattcccaatctctagtacacagtttggcaaagagaaggtgcttaataaatatttcttgaacagaaatatcattatcatcaaggctataactataaataatttatttgcaatttatattttattaaagattacaatactttttcactacctagaaaatgtgtttccatttagcttcttgataaacaatttttattttcacattttatagttcaactgttccattcaggccacatgtgaaaaacacattcttggaaattgattattcaaatttagctgttgatactgttttttcctccagttcaatgtgtagccaaatgtaactgctgaggggtaccctaatcactgaggttgatacttaagtaggactgtcaaagtcttctaagaaatgcttattagaaagtaaagatgggagaaaatatttgcaaactacccatctgacaagggattaataccagaatgtataagaagctcaaacaactcaataggaaacaaaaattaaataatctgattttaaaatgggcaaaagaatagacatttctcagaagaagacacatgaatggccaacaggtatatgacaaaatgctcaacatcattaaccatcagagacctgcaaatcaaaactacaatgagatagcatctcaccccagttacaatggcttttacccaaaagacaggcaataacaaatgctggcaaggatgtggagaaatgggaacacttatatactgtcggtgggaatgtaatttagtacagtcaccatgaagagcagtatggaggtaccctaaaaaaaactaaaaatagaactaccatatgctctagcaatcccactactatgtatacatgcaaaagaaaggaaacatatcatagcactatttacaatagccaagacatggaagcaacctaaatgtccatcaacagatgaatagataaagaaaacgtagtacatatacataatataatattattcagccattaaaagaatgaaatcttgtcatttgcaacaacatgaatggaattggaagatattatgtcaagtgaaataagtcaggcacagaaagacaaacgtcatcttcttactgatttgtgggaactaaaaatcaaaacaattgtacttacggagatagagagtagaaggatggttaccaggggctgaaaagggtagagggaagtgggggaaaaggtggggaaggttaataggtgcaaaaatatagtaagatagaatgaataagatctagcatttgatagcacaacagggtgactgtagtcaatgttaacatcatatattttaaaataactaaaatattggaataggaatgttcctaacaaagaaatgataaatgcttgaggtgatggataccctaattaccctgattacacattgtatgcctgtatcaaaacatcacatgttgtaaccccagcactttgggaggccgaggcaggcagatcacgaggtcaagagattgagaccatcctggccaacgtggtgaaaccttgtctaaactaaaaatacgaaagttagctggatgtggtggtgtgcacctgtagtcccagttacttgggaggctgaggcaggagaatcatttgaacccaggaggcagaggttgcagtgagccacgatcgcaccactgcactccagcctggctacagagcaagactctgtcaaaaaaaaaaaaaaatcacatgtacccataaatatgtacacctattatgtacccataactaaagataaaaaaattaaatgaccattagatcacctgtcagagacagagttgtatattagatgaccagaggtctgacacactgtagcacttttatccttatgagagtcacacaagacaagatcaacaaaaaatatattttacccttagaacaatgcatatttttcatttatttagtgcctactgtgctctaggtccccttgctaagtactgaagctacaaaagtgaataaattagaccctttcttcaagtagcttccagtctagtgcttattaacaatgattgttaggatataaaatacacaactctagtattagtctatgaagagtagtaatgttgttagtaaggtgaaatgggaataaaaatgacatagaataaagcatgatggttgatatcaaagtatcacctaggtattgactgttcacaggtcccagaatgaagctaacttgaatgaatctgcatctttcttgacagacaattcagcatcaacagatgatgaagggtttacttaggacaaatttgagagaatggaaacataatgcattagtgctctgatacccctgtgaaaggctccagatccccttctgtcacctgatgatttcccttccagtacttcaggcctttaagttcaagtgttttagtgttgaaattaagggttatttcttataatccttcatgagttataaaatgtcagagacataaattcaattaagggcaaccaaacagagttaaggaaatgaggaaaaaaattctgaaaggcttggccaattaatgaaataaaagaaacaagtccttataaacatgattttggaaatgtaagtagaaaaccaaagtaatattctcctaggatgaatagaatagtaagcatctttgaaattacttctcagaatatttctcagttggacaattcacctaaattaacaatttcctccatcttcactttttctaacattcagagcaagtgaggctcaaatgttcctaagctgatccatgatatcatgcccactgcctcatcgataatctaaaattcagaaagtatatgaagacagaaacaaaacaaaatgtcattaacattaattgagccacagggatgggctggcatggagtctgaggtagcaaaacatatacataaaaaatattctaagtagttttactttttcagatataacatgtataaactcaaattaataaaatagatgccttgataagcatgctttcatgaatggataaagtcaatgggaaataaatagcaacatttccacacaaacaccaagttcattcattggaaataacttgtttcctcaaattaacatgcttttggaaaagccatttacactcttatcttaactcaaaccaactcctcaaggatctatggaaatgctgaaggcaggccaggcatggttgtcatcaattaaaatctgtggaatccacattggtaaaatcttaccataggtgataaataaggacccaaattatatactccttattgaaaatattagtaggagtcaaagtaagacatacagaacagagcagggaaaagttgttcaagtttacatattgcatacacacatgatccaaaggagaaagcaaagcatacttggaaaataatccattgcattcaactagattgtttctgaattgctgttttaatacttcctcatatgtaaaatggaaataatagaatttgtttcacagagtggtcataaggatgaaatgggataaagatatgaaaagtgtgtttggaaattttgaaatgctaatccaataataacagtgaacattcatattcttcctacatgttaaaaacactgttctaaatccttatatactagtttcatcccatttttgagtcactgccctgtggtgggatgcttggaccctaccacgaggtgttagagaagggcccagcacaggcccagttgtgaaaaccatttataaatgttactttcagtagtatccctctccaaaggggcaaaacccaatgaacacaatgaaggcaaaagtaaaaatatacaccaatgcccccttactaaggaatgacacagtgtaaatataggtttacagaagagaatgaacatttttttttcatttgaaagtgttatttatgattgatgacatggataaagtgtgatgctaaagccaagcatgaacacctggaggaagagaccaaggccaactgctaggcaacatctgaaagttatgacaatacctaaactatactgagttaattatgagagccatgtaaaacatggtagatttgtagaaagtcatgaagccaaatccaacccaacctgatttcagtctctcctcccaggttaaataaatgttttctcatcctacctggaatcctgttttatccttctccctagctcccccttcacctcctcttcaccaccaacattttcacatgaaattttcaagaagaaaacaaacaaataagctgccactgtattctctgacaggttcattgagcaggcttgtatgttgtttgtcagagaagcagggttccattttgtgggggtagggtgccagggatggggtgaagtaaaaataatttgtgatcaaatatttgaaaacacttgccttgagtagacccagcttgagcctccatgtcacaacaaacaggagagaatttgaaacctgtaacagtaaacatttcactagttaagccttgtccaagtcatctgcaattcctcaaacttcaacccttacccttcatctagtggtgcttaaaaaaaacccagctttattgcaatataattcacatatgtaatattcatccttttaaagcatacaattcagtggtttttagtatttttgcagagttgcacaaccatcacatctatctaagtctagaatattttcatcaccccaaaagatacctcataacaagagacttgcaaaggtagaagaatagcagagcccagtggggaaacttctttcattttaatgtttcaacccagtgaatatgtccagagtgagatgaaggagaagatgtcttgccaatataagagatcacctaccaccccatttcatataattttgatcattgtttttcccaactgaaagacgaaacccagaaaactgtagtgaccagtcaaaggtctcctaacttctatcctaatgcctttcacttacatgaatatgctacatatgtcaaatatgttcccctctcatttccgtacgttacttcctatactcttggccaaagtcaacaatgcatacatgaacacatacatatatgaaaataatctaaaaaaaatcaagaccccaaggatacttggtgatattgtaaagtgttatggtctactatttaggacgtgatattctaactagtaggcaacctctaattcctgattatatggccagtatcacctttggattaaaggaggcagaagaggacaaaatagaaaaaacaaactgcaggtacagggcagctggctatctctctgccacctgaaaaagtactaattaccactgttaacagagtaagccttgtggtcatggtaatggggacttataaaatgtacacaaacagaatgatggagagactaatgtgtttaataagcagtaatgtgctttttatgaaaagattttgttctctggtaggagcaaaagaacagaaataaaataaattaacccctttccaacaaatcaaaaagacaaaattttccttttataaaagttgcaagaaaatcatatatgattatgacataatgatactgctgctagtccttattgtcaagcaaatggatgatgttcattcaccttctggttttttaaaccacttcagtccaacctggttaatttgcgtttgtacattcaacaggttaatctgaatccaaatagtaagcacatacagaatatgcttgctacacaactgttcatctcactgttcatttattgatataaagccaaaatacatgaaatttggacattctataataaattctactagtattgccgtggaaaataaagatgaaaataaaaggtgagtaataaacaaaacatgcacgatattatggattacatgagattatttcccttgggggctcaccgaaaatgaaaagtattttgtctgttattataaataaatgtctatttgccagatacttaggtgcatgccttgtccatgagtccctgctaacttgtatttccattctgcatattaaatgaaagaagggcagatatagggaaggagaacaaagcaaaggctaaaaactgcattctttctgtgttttacttaaacaattcaagtagtttattaccattttccccatcagacttcctttcatggtcagtgtcagtcaaggataatgcagagttggcccggctggacaaacaggaactatgctctgatttcattccccttatccacattcttagtgcatggtcaggtgaggcagcaccttctgtctctgtgtccacatcagatcccatctctagctggtagccatgccgagaaacgctgtgcatgtctgtttggtagccagagcacagagtgtgagaggtttcacagaattccatctctgagaagaaacaaagttcagagaaaacgtttagaagtatgaagaaatcccccagaaaattctactttttgttctcattcccctctcccccattggtagtaattacgtgtttttgcaagttagaattctggccttttattcatggtagctaggactctgtgcttattttgcacttctgtagcttaaaattatgctcctgttgattcttacaaggttctggaaaaagcgcgcccaaaatagttctatagctacaattttaggtttcacaaaatgtaatgaaataagtgagtgcagaggagtataaagtgtagagaggtgtcctttaaaagatatttcttttctaggaagaatatatatgatctgcagagtgtacctatgcttaaaatattaaaatgatttgcttttctaagtattccatacacattggatttaagaataaataattcaatgtgaaaactctgagaaaaaagcattaagttcaaatgcacttttctaaagtatttttcctaaaacatgttaatttaaactctaaatcatcagtacctaatatcattattttccattgattttaacggagttcaaggctgactttatgctaattattctatgtaattcatttttttccaataaatacacacaaaaatttagtcatatattgtaccttggcagtggttcatggattggatttcctctcctttccccctagatcttagagttataaaattttcagaaccttaaagatgatgcaacgaattccttctttttatagttgaggaaaataaactccagaggatagatattattttttcatagctcacatcagatagcaacagagccctttttcctaaaacacccatgtaggcatggtttctggtatacaacaacgatgccccatcaacttactgcatgaatatcaggcattcagtcttacagtcaattttacattcagttatagcaaggtgtcaaaaaggggaaaagatgatttaacaattgctaataagttaatgaaaaatgaccacatgccaagacatatcatctgaaatgtccatgtaatacttagataaggtaatccggagatgtagtacaccatacaggattttctcagactgacatcagagacaggatatgtcatttggctgggaaggagcttaactgagtgcatctaatccttagcacatatcaataaaatgcaaactctaacatgaatttaattctctgaatacagaaagtactggattttagaccatacactagaggaaagcaagcagaatatgaatatatttttaaaataactatttttggggcatataattaccaaataagggtttaacaaaaaattcttattgtttacttaataccactaggtgcatagcactgtgctttgtgaaacatatagtaggcaaataaagctactataatgtattagaaatattcaattaaaaattaactctttcagggttataagtcactgctgagtatgttaccttttgatttccatgatgaatgtatttaagagtaattccctttttctacaaaaacttggctaaattccaaaggagtagtattcaaaaaatagtcgtggtttccacttgtcaaacataacattttatgaaaccatgcttcttcctgccataaggctaaaagtaaaaatccattttgcccaatataaattttagcaatctagaatattgggatcagctaatattcatgcctcttaatttcacaatgtttcattatccaatcctactgtgcagttgttgctacagcaacctggtaataaacctttcagcttgaagctgcaagaaatgaattttatataggtctgtaacaacttacttcactcccctagaacagtggctctcaaacttggctgcttcagaatcacctagaaggcttgttaaaacatagattgctgcaccccactcccatccgtgccttccaatttaagtttctgattcagcaggtgtggagtagggccaaagaatctgcatttcgaatgacttccctggtgagacccatgctgttggtccagggatcatactttgaaatcgactgccctagagatttacttgaagtggatgggatccagggaatgggtagtagtgagggtgcaaacttatcatggcattaccacagattttgctgcatcatctttaattctgtttaaagatacaagaaagggagtttttgctctgaattgctgtgaagtgtctccatttatttcccctggattcagggcactaactagaaaatttacttccaagagcacagacttgcatttagtttcactcatacaacggcatatgagatgtggctttccaaagattttaatatgagcatctgagtcatggcattcgttggaaaaggttgagcaaataaaaataaatgtaggtccaatttgtcattccagattaataaaacaccagataaagttttttaaaaagcactgacagatgtaagcagatttcttttttattaaagagatatttttcccattcaaaaggaaattagaacatggatttgctcccttctaagaaaatgctgtgtaatctgattaaaaattacatagaataaacaatttattttctattgtaactatatcctgctttgcctacaaagactgactcataaattctctaattaaatacagtcagataaaagtacactttcttgtcaatctataattagaaaaagtaacaatccaaattagctatcagttgctcttcttttttaagtggtaaagcataaaaaaagaaaagagaaaaagtttcacttacttatagtaaccgatgtttattgaaatgcctcatttccttttcttgaaatcaatgtcaccattgtaaaatattttcctaaatacacaaacgtcttggtggtgctcaaaattcccaaaagatgcattatctataaagcacttacaacgcaccacaagtagttgttttctagccttgtacatataaccttgttacctaaagtactacatattctctagagaagataaagttcagcagcgtgatcagggctcactgcagccctgacttctgggctcaggtgattctcccacctctgcctcctgagtagctgggattacaggcacatgccatcacacctggctaatttttcatattttttatagagatagggtttcttcatgttgcccaggttggtctcgaactcctggactcaagcgatcttcctgccttggcctttcaaaatgctgggattacaggtgtgagccaccacacctagtctgtaccacattttctttatccaatctgtcattgatgggcatttaggttgattccatgtctttgctattatgaatagtgctgcaatgaacatctgagtgcatacgtctttatggtagaatgatttatattcctctgagtatataaccagtaatgggattgctgggtcgaatggtagttctgcttctagctctttaaggtattgccctactgctttccgcaatggttgaaattcaattttttaagtgggcaaaaagtttaaagagacacttcacaacaaacaatagaggtggccaataagcaaatgaaaagatgctcaacatcactgttaccatgaaaatgcaaactaaagccacaatgagataccactacatacccactactatggctaaaaaaaattctgcccacaagaagtgttgagaaagaatgtggagcaattgcaattctcatacactggtggtgagaaagtaaaactgtgcaaccacataagaaaaaagtgtggcagttttctgaaaagttaaagccatacttaccaaaagagcaattggactcttggacatttatcacaaagaaatgaaaacttctgtccaaaactgtacaaagttgttcataccagctttattcaaaaatagctaaaaagtacaaatgtcccaagtatctatgaacacatgaatggataatccacctgtggtatatttacataatggaatattactcagtcctaaaaaggaatggactattgatgcataacaatgttatggacttcaaaatgactctgctaagtgaaagaagacagacaaaaatctacatatggtatgcttccatttatataaaattctagaaaattcagactaatctactgtgacataaagccaatacgtggttgcctggggaaaagggtggagggagagatggataacaagggacacaaaaaaactttggggtgatctaaatgtccgttaccttgattgtggtgatagtttcacaggtgtatacatgccaaagtttatcatattgcacaccttaagtatacgtagtaagtgtagtttattatacttcaattatacccctacaaagatttttagttgattgtacaccaccagatattaaaacaacaaggagacttttgaatcaattttcacagctagaaggaggtcttgctcttttctctctagtggaataaagtaaatgtaacacgaacaaaaaggtagtcaaaatgtcatcttgcttatatctaagccaagaggccatgaagactaactgatgcatgatttattttttctttctttcttcttcttcttcttttttttttttttcttgagattgagttttgctcttgttgttcaggctggagcacaatggtgtggtctcggctcactgcaacctccacttcccgggttcaagtgattctcctgcctcaccctcccaagtagctgggattacaggtgcctgccaccatgcccagctaatttttgtatttttagtagagacggggtttcaccatgttggccaggctggtctcgaactcctgacctcaggcgatccatctgcttcagcctcccaaagtactgggattacaggcatgagccactatgcccgactgatgcatgatttctcagtgatcttctagggtgtacttttgtcctagacacataagagttgaacatcaaatttaggagggaaactaaggatgaaactcatcactgctaagctttcagcagctagggaaacatttatggttgaggatcatgagattgagtagagctggtctggcacataggaccaccttagacatctactaatgctaacaaattaataatttttttttaaatgctatgaagcactgaaaaaaaaataaatgactctactttctgaatctaggggttgatcatcaggtgttcagcctaaagaagccatttatcaaaacttgagaaggaaagttatagctatctgtatcagtgtttttctagaaatgccatttctgtgttttgttttgtttgtttgagacagggtttcactctgtcactcaggctggagtgcagtggcacgatcttggctcactgcagcctcgacctcccaggttcaggtgatcctcctcccacctcagcctcttgagtagctgggactacaggcatgcaccaccacacacagataattttaaaattatttgtagagaagagctccccccagtgttgcccaggctggtcttgaactcctggactcaagcattacaagtattagccaccatacccggccaatttctgtgtttctgataagctcaagactattttttctaaaattctacctccccatgcttcctctaaaaagtgagctttaaggcattatgctccaaataagtaattggaagtcaagaagtgtgattaattttaaccatgacctgagaaatttgggatataacttttaaagagtatagcccatttccaaaataaaggagaggggggaggggatagaattattagtttaattactgtgactcataacaacccttatagattacatgcagaagcaagtgttattaattatccatttggtttttggataagtcacttaacattttgggggctagttttctcatttgtaagatgtatggatccaactagaaataaatctctacgtaactgccttgttctaaaattctataattataacccgaacctgttatccaacatatgtaatggtcaatgtgttcaaatgggaaaagagttagtagtttcatgaatcaaggagccatttatacttctttgtgaaggatatagtacatattagttaaataagatcttgtgccataattataattcctgctatattaaagtattgatacagcctatgtacctactatgaattgcaagattattgatagagaaacagagaatctacaacttaaaatgtaaaaagcaactgagtaaattgttactcatcaaatataaaagtatccatttacaacatggctattggaaacataatgaataaaattcacacaattaaaaatattactgacccactaataattcattactggctccagggaaaaatgcaatggattattacaatcttaagcaagaaatacagagacaaagaagtaagtaacaccagataagaggcaaataattttcactactgggtaccattttctatttctcagtttgagggctttaaaaagaaaacggtatcaaattgtcaaccaaatcagttcaagtaaatttacttaaacacagcttcactgaacacccactcaatttaaagtaaagaaatcaaaacaaaatagtctcctctgatttctcttagtcttagaaaattagttcaatttaatttcctcctttcttcatgaaaatgttttatcaaatgtacagtgctatactaggcagtgagcagagtgagttaacaggaccttgtcatgtcctttgggaagttccacacagagcctttttaagcccctaatgataacaaggtaataaaggcacattgtctaaacctgacttttatttttctgctgagggctcatcagctttttctggggcacaggagtgagagatggaatgctcccatgtgcaagactggagcctgtggttataagatgacttaaataaaataactaagcttcctggagcctaatctccccttgacagttccaaatgcacccattatctcggcactcaggacctactaattatgccttatttaattttcaagatttctccatctgtcagtatacggaaaagcatggcaacaaatctgggcagagttaaaagcctgaagtagaaacattcatgctttgtgaccaatattagctaactggagacatcccagaatgcagttaaaaggctatgttaatatcaaaaaaaggatgctctcaggagtacaatgaattaaaaatctgtaaaaatggctcaaatcagaggacacagaattgtatcaggactcaaaaggaaagaagacgaggtagaaacctggaagaaatcaaaacaactccaatcatatttagagagagattaaaatatccttcagcaatctaagaagaggaagaaaatttgatgtgggaataagcaaatgctaactatttccttaaactaattttcaccttagtgaacggctccatttagactgtattcacataagatgggagcacttgttttgaagctaactcagcagttaccactacaatgacaaaaattggatgcttgctctacaatatttgtaataagagtctggaaaaagaatcagggactagaaaagatggtgggaggtcctggacttcaacagaaatttagatcaatgagaacctgtgcatgttccctttatttcaacattttgaatgagacagagacttcctggcctaaatgagaaattttcagggctactgaacactgaaaatgcatggtgctcaatggccctaaaaatttctcatttcttacatgtgctggcccaattttctggctggtcataactcgttggaacctgaatccttgttgcccattgtggtcttccaggtatacttgtgtatttccattatgttcactaagtatgtgcagctttttggtcaatgggtgcgtgtgtgtgtgcgtgtgtgtgtgtgtctgaaattttaaactacatcaatctgctgcacaattctatctagagaagtgagatcaatgagctagagttaaataaccattaaaaacacttgtgagtgcttcaaatacatactcatagaggcaagcaatattatttctgtaacattctatacttctctgtaagcatttactttgtgatgaatgagtaaagatgccaagatagaatggtacaacagagtcagcgtccatcatcaactacagaataaattacattctaaggtggtattgccatcccctcagaacttagactacttctaggcaaagagtgaccctaaacaccaaagtttaaaaattagtagttaacatggaaccactcttgaaagggttaacaacttgaacccaattctgacacatttgaggtggtttagcttaacataaaacaatgcctaccaatgcaaattgaaaaattgttattttggtaaattagctgtctgtttcaaataacagatgttccacaaatttggcaagaggagaaagacagcagcccactggctgtgaattcaggaaaatacaatttataatattagactaatggagaacaagtactcagtatcatcttctgactgaaatagtcacacaaaggaagctttctacactatactttttggcataatgaactgggaaataattgcctgttaaaattcttcagaaatgtactctagggtgtagaactggggaaattttactgaaactagtcacaaagccttggtaaaagaccatctttaagctggcttgaatagaaacttcttttgtcattctcatcaaccagtttcatgccatatcccagatagaatttatcatctcagtaagtttgtagaatgccctggagtgggtatgtagctcttctgacagcctgttttcaggaactcagagaatgttactaaaaaaaataagtcagggatagaaaaaagaaattctggctggatgtgggtggctcttgactataatcccaccactttgggaagccaaggtgggaggattgcttgagccaggagtttgaaaccaggctgagtaacaaagtgagactctgtctcaattaaaaaaaaaattagccaggtgtggtggcatgtgcttgtagtcccagctacttgagagactgggaggatcacttgagcccctgagtttgaggctgcaccactgttactcaagcctaggtgacagtgtgagacctcatcataaataaataaataaatgaatgaatgaatgaataaattttctaagttgggaaagattgagaaaataactttttggacactcatcaggaacttgcaaatttgaattccattcagaggaaaacattaaattctggagaagacttccacttgcaaacaagatggagtgacagcaaccaaatttattctcctgccttaaatgacaacaacgaaagccacacaaaatgtatgaaacaacagttttcaggcattggacaacagataatgaaggacaacaatccctgagatatgagaaacaaattaggtaaaccctgtaagagtttccaggcctcaggacaaggagggggatcacaggtagagcctggtagtctctttgagttgagaagactaagctggtagtgcgggaaggccaagatagctagagtttgcagtacggagtaccagagaggagagaactgcacagaaaaagaattccatagatcttcagagggtcccccctgcatattcacctgcactctggacagcacatgcgtgcaagaaaaccatctgagaatggagaaagagccatcagaaaggaataaaagaaacaacttctgaatctgaaacagggctggaaatagtcactgtttccaacatccacagtggaaaacctcataattcatgggcattgaatagaatactcaaaacagattttgaattcatagatagatgttcctcgacttacaatggggtaacattctgataaacccattgtaacctgaaaatattgtaagtcaaaaatgcctttaatacacctaatccactgaacatcataacttagtctagcctaccttaaatgtgctcagaacacttacattagcttacagatgagcaaaagcatctaacacagaggctatctttataataaagtgctgactatctcatgtaatttatagaatgctataccaaaaatgaaaaacagaatggttgtatgggtactcaaagtattttttctgctgaatgtgtattgcttttaaaccatcataaagtaaaaaaaaattaagttgaatcattataagttgaaccattgtaagttggggactgtctgtatatatttgcgtataaagctttgttctagtgtgtgcttaaattacttggcaacatttttatccttttgggtcttgctattaagctttgttaggtgggtgcagagcaatgttggccctagatatcttcatgtcttataaagttatatgtacacttaccatatgatctaactattccaaccctcaatatttaccaaagataaataaaatcacatgtccttacaaagatttgtacacaaatgctcatagaagctttatttgtaagagccaaagctggaaataaagaacatcaataggcaaatgaatgcaaactctggtacatccatacaatggaatactactgagacataaaaaggaatgatctattaatataaataatataacgacataaacaaatatcaagataattatgctgagttaaagaggccaaataaaaagtctacatactgtgtgcttccaggtatgtaagtatccagaaaatgcaaactaatatatagtgagggaaagcagatcagtagttgcctggactggggtgtgtggggagtggaggatataggcattataaagcagtgaaaggaaacttttaggggtggtaggtaggttcactgtgatgattgtggtgatgttttcatggatatatacatatgtaaaatttaccaactcgtatactctatatatagtttattgtatgtcaattttacctcaataaagatgtttctagaaaatacagggggaagacaagaatgtactctgcttgcctaatttaaatggccaagaagaacactgggaacaatgaaacaaagcagcaaggctgataaaacagaaaaaccaatctgtgttcacacactgtcatcaatgagggaaatggacagatcaatttctctcaacttgtctgccattttacttttactccaggggaatccgaagggcttaaattctggataccaaaatcctgaatggctagattggtacagactaatgcaaacatgaccaacaaatgaggtttattcctaatctggcaggaaagattcatgggccaatctgggctcaatgataaagtaccatgacagattaggtagactcaatgatatcggtgacacatttgccatttccaccttaacagtctagttgcctttgttttgtcccatagctacaaatttctctcataatcctggctattcattctggttgaatgcatgtcatttatttccaagaactagatgagaggatatggttaactcagcgcaaatgaagccctattatttaaaaaaccctcagaatctacttctcaacaataagaggttgataatgtaccctttgtttaccattaatttctacaaagactctttagtggcatagcatatatagtcaatggcagaatgggttattatatgcaaacactaacatagtagtcatatactcttataatcagggtcagtcaacctcattctgaagtatagtagatctgaaccaacacaattatttttgagagtggtatttacattacagtcctatcattacaaacttttatttagaaagaaaggccattctctattagctgtggaagttggaaaactaacttatctcagttatcagaaaattcacttgcaactgactaagcacaagatttttaatttaaccacttctaggtagttctgatttcaaagcacgcattccctagtcctggggcagaaatgaatggaggtcaagctagcaaaaagcatgcagttttacatatcaaaaaaagaagaaagtaaatccaaacatgaatttagcatcttcttttttaaattttattttactttaagttcatgtgccaaatgtgcaggtttgttacataggtatacatgtgccatggtggtttgctgcacctatcaacccgtcacctaggttttaagccctgcatgcattaggtatttgccctaatgctctccctcctctagccccctacctcctgacaggccccagtgtatgacgttcccctccctgtgtccatgtgttctcattgttcaactcccacttatgagtgagaacacacagtgtttggttttctgttcctgtgttagtttgccaaggatgatggtttccagcctcatccatgtccctgcaaaggacatgaactcatccttttttatggctacatagtattccatgatatatatgtaccacattttcgttatccagtgcccatcactgatgggcatttgggttggttccaagtctttcctattgtacatagtgttgcaataaacatacgtgtgcatgttctcagaacttaaagtaaatttttttaaaaaagaagatgctaaattaatgtttggatttactttcttcttcctcttttttaatatgtaaaactgcatgttccttggtagcttgacctccatgaatttagcattttctatgtaccaagccctgaaacatatattatttcatttaatcctcagagtagccctgagagaaaggttgttattattccaatttttttttttttttagatggagtctcgctcttgtctcccaggctggagtgcagtgatgcgatcttggctcactgcaacctccacctcccgggttcaagtgagtctcctgcctcaggctcctgagtagctgagattataggcacccgccaccatgcttggctaatttttgtacttttagtagagacgtggtttcgccatattggccaggctggtctcgaactcctgacctcaggtgatatgcccgcctcggcctcccaaagtgctgggattacaggcttgagccactgtgcccagcttattagtcctgtttttcaaataaagcaaccaacattcaatgacagattaaataaattgtccaaagtcacacagataccaactggcaatgctaacttggaaccattttaacaccatcctaatgacctcatgcagcatattataagcagcacattcaaattcacagcttagtcctcatttgtgcaatgtgaatgtggcggatgctagaacttcctgcttcttgtctcccaggtttcattcagttcactgctgtctccatctggatttccacagccagccgccaaaatactttgagggatatagcagccaggagacaatgggcacttcttttgtcactgacaatataaaaatagacccttaaactatgcatatatcattaatagcttattgttctatatgagtttaatgcatttttgtacctccttttgaagtattattccactctgtactaattcttatggattcactttacccgcaacttgtcactttgactcattgaaaacaacaatgatattttagagcatattctgtgcttccagacaacacaaacaacatctgtgtctgcaggcggacaaataaaagaaaacattggcctctcttgtgtttagctccctagcacagagcagctgccttgaggagagttttgaaattatttaacaacattaacaaagatgagaggaataatattcactgagaaatgtgtgttggggtattacttcagcatgttatcacccaactagaggaagcaatcagatcaaattttgggggcagttcctgtttacaaggtagtattatcatctcatgctaaatagactaagcctatatctgtgatctacattcagagttttacacgtatcacagtacacagagaaaggctttgagttgaaaatattctacagtttatggtaaaatgtttaggaacatttttctttatttgaaatttatcaaggaggtatgaaattagataaaggcatgcttctctttacctccacactatcatttagtgctaacactgcaggcaattcttgcaaaatgcattttccaaaacctctcaaagctagaaagcaaatgcaaacagcaacaatgacattagtgcttttgaactggaaacttatattatccaaatccttattatcattgccccaaacacttaatctgaacaatcaaattaatgtttcaggcatttaaaaaacaatggacaatctatatacatgaatgcatgttccttttacacattttggaaggatgtgcaggtaaaacaatctatgaggattgcccaaggacattaatgatatacaggatagatgtaatatgagtctacatgatgcctggaacagttgactccatttggtccccaaatcatcaccttggggggaaaaagcacaaagagccaaatagtgatttgatagtatattgacaaaacacatgcttggctaaatgttcacttttgacatagttacttggctttgtcactggttccaaggtttctcctaggcacaatttaaggtagatctgttccttttgtccatccactgtctgtcaccctctccctccccatattcagcatcaattactttggccgttttcacttccttttccagaattctagctccatttgttttttccccctttcttgttcaaatgttctcatttcttggccagttgcctaacagcacagcagtatgttagcgaatctgaaaaagttaagctaggtttggtatactttctcttccctgactaatgccaaattatatattataattttttttttttttgagacagggtcttgctctgtcacccaggctttggagtgcagtggtgcgatcacagctcactgcagctttgacctcgtgggcttaagccatccttctgcctcagtctcccaagtagctgggactacaggtgtgtgccaccacacccggctaattttttaattttttatacagatggggccttactatgttgcccaggctgttgtcgaactcctgagctcaggtgatcttcctgcctccacctcccaaagtgctgggattacacacataagctacggcacttggcctataatttttaatagagcacttcaacccttagttttcatgccctcagtccatatgttattcaataagcactcacggagcacctatggtgtgacagacactgtggtaggatccaggcagattagagagaaggaaaaagatacgtcctcttccctcgaagggctgacaatctattgcagacatggaaatgatgataggacaaggaggtaagtaagtgccgtgatagatctatacataaagggctgtggagtctaagcaaagtgagggactcactctgcctgaaagactgagacaggctccagagaagtgatactttgagtttcatcttaaaggatgaatgcacttctggtaggttaaaaagtggataagagcatttctagcacagagaagtgtgtgttcaagggcaaagacaagtgtaagggaataatgaaattaaagaacagcaaacaattttctgcatctgtactataagtgtaggggtagaagaaccagtaaagtgggatggagccagtttgtaaagggccttatataccatactaaggaattgggccttgtttgccttagattatatctcatgctgcttactattcctgtgtgctagggctccagaatcattaatctgaacacaaataaccgagtttacaatttttttgcatacatctacaaagcagcctggaaattcgctagctgtgagttttaatccagaatgtaagaaaattcatttaactagaaaatatttattaaccacctaacgtagcaagcattgttccaggtatcagagataaagcaatgaacaaaacaggcaaaaatccctgccgtcatggaactcatattctagcggaaataaatttgtaataactgtgctcagtcaaaatttagtatcagaatcacacagattttcatctgtatattaatctatatgttattgtctgtgcatttcatctcggtattaactcaggttcctccagagggtcagcaaaattgagtatatgaaagcagtgacaagtaggaatttagcttcttccatcgaactgaaatctactaggtgaaaaccatgtcaatggcttctctgtacagtatcctccatttgagggaagttgaggaccctgggagactatgctgagatatgccacatttgtccctgttctgtgtgttcacttttcttcccaaaatatttttggctaaatacttggaaactcaatatcctgagagaggggataaggagagagggagcaagaaagagggatggagaaagggttggggagagagttttattttgttggggggaagagctcttctagtcaacccagagcccacctgcaacaccataatcaccatgcacttcagagatggggagctggggtggggttgggggaagaaaaattgaattactctacagtgtagctataaaattataagtgtaacactgttcacttcatgacgtataatcaataaataaaagtccagtcttgaaagggtgtgctatataaatgccaaatagtatttgctctgaaaattccaaatctgggtagggttatttaaaaacagtccacttgcgaacagtttgattttagcattgggctaaaattataaaaagacaactttcattcatctaggaaatcagttttatttcttaaactacataaaattcaaatgggccttaggagaggtgtgaaaagaaagctaactggaaaggccattttgaattataattattcatatataaaactaaaatatatatcatctactggtatattaaaaatatcactagattccaagggtacctttcaataagaacctctttccattaagaattagtaaaaaaatataaaattggatgcactggaatgtaaaagttggaaaaacattgatcataatttttttcttactaataccattgacttaaaagagatactggatttttataaatagaactagcaatttatatctactatacatttatatacgttcccatagtgattccataaataaatattttacaaatataaagaaaaaaacgaacttccacaccctctccccaagctcttcatattaaaaaagaaatatcctagttctcctagtaaggtgacagaaaactacttactgctcagacatgcattagtgtgtggagactagggtaccattaaagcaactggaggaggtaatttagtaaaagcaccccctactagtttgaagagttaatgtgtttctctcctgttaagtgggtgatttctttttgcttgccagcaacataatgaccaatatatggtacacactgtgagcaatgggccttcttgataaaaatgattaataggtatataggtctatacatatatacacatgtgcacacaattctcacattgtgaatttagccataccttaatttatgctttatgtaacacaagagactggctccagtggaatattctataaaaccagaggccaacctccagccaaaaataaagacaacaaaattatgactgctttctgaagtagagaataatggaaaatcttactatactataaagtatggagaaacaggcatatgcttataccaatttttgtattcactaacttgtcacctcaccatagccactgcttgtcatatgtaattatggtattttttgatctccacaaaagtaataatagtcataacagcaacaacaaataatggttattctagtgcttgtcctgtggcaaacactgtgctatacactttacatacattctgcatttaatactgaacaatagcttcctgaggcatgtattattatcttgtattgataagcaaggaaactgactctgaagggttaaaatacttgaccatggtcaccattcctagtaagaggtgaagtcaaaattcaaatccaattttgtttgtatttaacaccttttgcttctaatattgctttagtggcagaaaggctatgcattcacttcgttacaggtaaaatgatctcttactacatgtatatctgctggtggtaaggaggtataatgtaatctaatatggatctctaatttcaacaaacttaatgtctggtaatggaaacaacatatatccccatatatattgtagagtatataactggaacctaatgattggttcaggcaataaacactaggagagggcacagaggagaggaagaatagaatgagaaaaatgggtcagtgactcttgtggagttggtagattaagctaggatttgatgaatgggtaaggcttgaatgaaagagggtagagtttagactccagtactgttgtccaggttgtatatccaactattcatttgtcatatagatatttaaaagacgccttacatttttaaaaatgtccacagctaactttattatcactgccttcaaattgatcctcctttaccattgcctttttgtgaatataagtatcatccattcatttgcacaggccagaaacataggcatcccccataccatcatttttatcttctaattatatcttgagccaatacagttttttccattttcacattcaataatctctggcctagatgactgcaatgacctaactggtacccttccatccaatcttgttaccctctaatctattgtttgcaatgctaccagacagaatgctaaaaactaatcacatcacctcccttcagtatattcccattacatttaggataaatatcaaaatctttaacatgctttacaaagtcttatgttatttggttccctgtctacttctctggccactcactctcttgcttctgcaacatgtacttcttccagtttctcaaatacgccatcctacttttcacctcatgacatttgtgcatgttgttcctcttctccttcctgcccctttccatctcttcatttggttaattctttcttatatttgatttcatctcacttccttgaccctccagaccagattaggtccttctttctctggagtacttatcacagtcatcacatcataattttaggatcagttttataattacataaaaactctctactcctactaaaatgtaaattctcggctggatgtggtggctcacgcctgtaatcctaacactttggaaggctgaggcaggcggatcacctgaggttaggagtttgagaccagcctggccaacatggtgaaaccctgtctctactaaagttacaaaaattagccaggcatagtggtgcatgcccgtaatcccagctacccgggaggctgaggcaggagaatcgctggaacccaggaggcagaggctgtagtgagccgatatcgcaccactgcactctagcctatgtgacagagtgagactttgtctcaaaaagaaaaaaagtaaattctctgagggcagggaccatgtctgtcttgttcatcattgtataaccagtatccaaaaaactttgcacacatagaagcataaataaatatttggtgaatatagcagtgtatctcaaaagcattctaagcaaggatgatagtagaaacacaccataaagaatgatgattccatatctggaggactgatgattgcatgagtgtagcttcacacggagtgctttgctcagtaaatattcaagtctggctggtttaaagggttcatacagatggaaaaaagggagaaaatactggaaaaaagattttgaaggtcttaataagcatctcaggatttattctacaggcaatagagaacaaccaaaggcttgaggtggttcagaactgcctgtcaaaaatctgctgctatcccaactgcacatgtattctccattttagcctggtgcttccaaatacatgtccctactttcagcatctctagaccattcatgtttggagagactcctacccaacagaactgccacatggtggaatgtttggcttacagtgattcccccagtgaccatctacatactgcaatctcacctctttgaaaaaaaaccattgttttacccccattttagacttgtgatctgaaaagctcctacctttgtattgcagtctttgccacaattataattgtttaaggggtggacacctgatccagtctgggccaatcatatttcccacctgctatggtttgaatgttttccccctccaaaactcatactgaatttttttttctttttgagatctggtcttgtcctgtcactcaggctgtagtgcagtagcatcatcatagctcactgtaacctcgacctcctgggttcaagtgattctcccaactcagtcttccttgtagctgggaccacaggtgtacatcactatgcccaactaaattttttaaaagatttttgtagagatgggggtctcactttgttttccaggctggtctcaaactcctggattaaagtaatcttcctgcctgggcctcccaaagtgctgtgattataggcagttctcatgttgaaatttaattgtcattataacagtattaaaaagtaggacctttaaaacacgattgggtcatgatgagggcttcaccctcatgactggattaatgccattattgtgggaatgggtttgttaatttgttaccacaggaataggctcattataaaatggcgagttcaccccctttctctctctctctctctctctctctctttctacctttccactcctcatctttgcccttctgccatgtgatgacacaaaaagacatctttagccactggactccccagccttcagaaccgtgagccaataaatttctgttcattataaattatccagtctatggtattcttttggagcagcataaaacaaaccaagaatggaccaagacacctcctccctgtccccactgattagtccagatattgatatgggaaataagctagtccaatccaggttcattttcaggttttcttaattttttaaatgtttactgaaagcaggcagaagaggatctctttccttttagttagctaggctgtaaggttgacagcccggagcagtcagcagtagccagctgtccatcttgtacataataaagctggcctgcagagagaggtaggaatacaagggagtcttgacagttttccagtccatgactccaacctgtgttccagtttttgctaagaccatgttccaccttgttgtttggttacttgagccaaaaaaactttttttttctcttaagctagttggagttgggctaccaccattcactgtcggagttctgactaatacaaatatcagaagtggtggcctagagatgaattagcaaagtatcttcaggatcaggtctctgctaatgaatgtttgtagctcattccttaaccccacatagacttcctgcttctcattttttgacttggattttaaactgtccttcactatatcacctccacaaccacaggaccaaagaaagcctggtgcacaatcagtgcttgataattatctattgaactgaattgagttgtgataaattctcctatagatttttaatcttctcatctcttcaactacaatatgccttgtttatgtgcttgctctgctagctggtcattcccttttttgctgcctcctgatataatttgactctgaacacccctgtctaattcattcattttctgtgcaaatttctgctccttactagtatattcactgggttatgtgcttttctcaactttatcaaatgaaataaagccacttgactattatttgctcatcactcttccatgatagccaggtaatctataggcttagaattctctacgctctgacatcagctttgtccctagaaatgaaatagaaagggaacatctagctcataagatgtggactcaatttgaagctctgtttttgatgctggtttcttagctcaggttaaacaaacagaaaccttctctacattcttcctttttctacccagactccctggcctgagcttcatatcctagcttgggctatttctggagtacaggaattgatatttgcaagtaggaattagagggagacaacacaaagaagatactgaatttttttttttttttgagttggtgtctggctctgtcacccaggctagagtgcagtggcatgatctcgactcattgcaatctccgcctcccaggttcaagcgattctccagcttcagcctccagagtagctgggactacaggcgcgtgccaccacgtctggctaatttttgtatttttaatagggatggggtttcaccatgctggccaggctggtactgaactcctgacctcaggtgatccacctgccttggcctcccatagtgttgggattacaggcttgagccatcgcgcccagccgaggctgaaaatttgagccagatagtaaccagttttctaacagaagcaaaggaatgtcatggtgaggctctgagcctgaagagaaattacaaaaaaaaaaaaaaaaatactattcattgccctacccattcaattccttgagaaacaaaagtgaaagaggccttattcaagtcaatgttaaataagagaagggaactgacattaagaaagtgcctactttgtgccagacactgtgcgaagacctatccatatatttcgcacttaaagatacagtcatcacaatgactcagagaggtaggcattattcactttacagatgagagaacaaggtcaagtcaagtaacctgccatgttaagtaatattggcaattttttaaaaaatggagctaggatttgattacagatctgttcccatttagactgggtaagccagaccttcaggtacctacactccagccacatctatgctaaacattgtctgaacattgtcctatgttcccattttgcagctccagtgattctttgcatagaaagccatacttccccatatctacctcttgaaagttgtaacagtttttcaaggcttacttcaaattatctcttttctaagcctcgctttagccaaagttaacctggccctctccatagtctcacagtgccctattcaaacttttatttgatactcattgaatgccttatagtggtactctgatttgtctatttatttcgctacaacactgaacagacagatcacaatggccatgtaggttcttggcagattgtgatatctgtgatatttcgatcaattgaaagctgtgccatgatagtctacaaaaaagactacaggataaataaattatggttcagtcacacaatggaatattatataaccttgaaaataaatgagctatgtacattaacatggatgcatgtcagtaatgtaacattgagcacaaaaagcaattcatagaaacacaatatgattatatttaagaaatttgtaaacatatgaaactgaaaaacatatttttagggatgcatacatacatggcaaaactataaggaaaagcaagggaatgataaacacatttcaggatgacggtcatctagtagggaagtgagggaagagggctgggatctgaaaagatcacacagcagaggcaaaaaggtaattagtaatgctctatttcttaagctacatggtgaatacataaaactttaattattgaaactcaaaccaaaaatttcaaccaaatgacttttttccctctagctttctactgtaagaaaataaaagtgaatgaaaagcaaacacatcatttcagggatttaatcaatgagggtagctaccaggggcttttctgtactgaaaagaacttggcatcagagaactgggtttgaatcctggctctataaatgtagcaattgtcattattattagggcttcaggcaaaaagaaccgatactcaaaataatgaacataagtcactaaagatgatcagtcatagaatgaaggttcaaaaatgcttcctcgatgtcacactggggtagaaaaggagtcattttagaaagattttcaacaattaaagatgggaatttaaaaatatatgattaattctgaatcaacaaaaaaaatacggattaatgaaaattcctcattccctaaacatcatgctgactgaaaggttactatactttcattgtttttatttattgtttgaaaaatgcagaaaacacataaatacataaacacataagcataaacacttttttgtgtttttacaagactgagataatgttatatgtaatgttttgcaattttcctctcaatagtatgtcatggatatctttcctgtgttagaacacgtagatctacttaactttttttcatatttgcaaggaatttctttgtctgaggctactataatttatttgaccagaaccacacatttagcttatttccaagtatttactattataagcaatgttcaatggccatccttgcatatacacctttctgcactcttgctttattctttctgtaagataaattcctgaaagtctgattgctgggtcacaatgcatgtgctttttgaattttattagattctcataaaaaattgttctagttcatatttccccccacagttccagcttcctcatacccttacagtaaatatttgaatcattttctttttccttttgccaaattaggtgaaaaagttacttcatttttatttatatatatttatacttactttctattaatttgaacatcatttcatatatttattggtattgtgtaattctttcatttttatatggaatgtgctatccatatacattgcattttgtatgtaccagatattatctcccaacctattgttttcccatccccccttactgttgtttatgggcattcaatttttacattatcaaatctgtcatttttttttcctttatgggttctgggtttcatgcttcacttaggaagtccctttatataacaagacttttttttttttttttttaaagaccttacctctagtttcccctaaatctcacgcccctcttttaatgaccaaataatgctatcaactcaggctttgtctgactttatgaacagaggtcaagtcccttccacacatcaagagctattgctgcttatttctctttatcattcttatttatactgtataagatgttttagaaattacccccccaaattctcattattacaattaaaataatacagttgttcataaagacaaaattaataaataactccctatctaacttctccaatcttgtcacaaggcaactgatactcattgtagagtgaaggtctttccatacctttctctagacccataaaaatatatacaaacagacacattaaaaaactttccatttatttttatgaaaattgggtattttatgtattatactatacttgtttgttttatataacaatataacatgcatgtttccttaagatagaatatgcttctaactcattgtttcaaaatctggaaatattaaatgttatatgttataaatgtaccattaattatttaactaatgccctattgctggacatccaagttgcttccttttgttgtcattgttaaccctacaatgtcacttttataatccttctcacttctcttcctaaccccatgagatcttctggatcttgttagtcctcccttcttctcactcccactcctgtgttttgttgggatagtttagtatatttatttagacgcttgtgctgtccatatggtagccactagccacatgtgactattgtacacttgaaatgtggctagtctgaactgagatctactgcaagtacaaaatacatgtgggatttttaagacttagcacaaaagaagaatgcaaagtatttcattaatactttttatattgattacacgttgaaatgatactattttagatatttaagtcaatctgcctttccatttagatttaattacttttccagagagccaggttcattgcccatcattgtttcttctctcatcttgaagtctccattccgattcatttattatttagtttgagttttttctcaaatattttttcactggtgtatgagagtgatatactttttgaattcttacatgtcctcaaacatctttctctgacccaagtggatgaatgataccttgactggatggtaagttacttggtttgcagtctttttctcttagaaatttctagatgctattccactgtcttctagcttccacgatatagatgagaaaaccatttttttctttgtagatgattcagtttttctgccaaaaagcctgaaagattttctctttatccttgagatttaggaagtatatcagtgtatttttcagtgtagaacaaagtatgcctcttttatacatattttcgcagaccagcttttggctttgttaattgcacattgaaattttgtaattattttagcttatatttttattacttttgtacagatacttttatgtgaaatatatatctatatattctttttctgttcctgagttgaaagatttttttcaatatttctttaaattcagttaatgctataaggaaaatttatagcgttaaatgaatttaaagaaataataaattttaatttaaatgtatattttgtgcaaagtcttgaaaatcccacatatattttttacttgcagctctcatgtttttagccacattcctagattatttaggaagtaatataatttttgttcatttttaaataattttaaaattttcttttgattttctctttgatccaaaaattacttacataaagtattttatggttcttctaagttttttcctgtttaccttttctggtctttgaattgttgatttctagctttacagaattcttgtcagaggatgttacctgccagttttccacttgagaatttattaaggttttccttgtggcaaagtacatgataaattttgtaaatggtccaggggcataaaatacaaatgtggttttgtttttggcattagagtatctaattctatttatttgacaaaatattaggtcaagcttcataattattcaaatccttggtattattttttgcctacttttcaaattctgagaaatctgtatttcacaactgtaactgcagttttatcaaatgcttcacatatcattccatacagttacatctaataaatatttgtttatggaatgaatccctctaggttctattttaatgcttttggccttaaattccacttaatctgatattgacatccttgccctatcctctccttattgaaaattccctggcatatcttcatctgttcctttattttgaaacagtttcatcattttgtttaatgtttgtcacttatatatgtacttagctaaaatgcgtaaatctgagtggttttgtctgggaataaaatttgtcaacccatttccattattgtaacaaacacaatgtcttaatcatagtataacaatgtatgtttattatctttgtggtaggcagaataatgcctaaagacatccatattctaatacccacaacatacaaatatgttaggttacatggcaaagggaaatgaaggttgcagatgaaattaaagttaataatccgttgacattaagatagggagactattctggattatctaagtatacccaacgtactcacaagggtccttaaaagtagacgagtgaggcagaagtatcaaagaatgtatgacggggaagatggatcaaatagacatgaaatcgctggctttgaagatggaggaagagatcatgagccaaagaatatgagcagcctctagaagctggaaaatgcaagaaaaacaggttttctcctagagctttcagaaaggaatagagccttgctgatatcttgattttagcctggtgagactcatttcatacttctgactatccagaactgtaagataacacatttgtgttgttttaagccactaagtttatggtaagttgttatagtggcaatagaaaactaatgcaatattataaaatgtaaataacagtttgtttccaaattactgtggacagtggatggataacggggaaaagtcaattcaaaaattaaatgaattaatattcttacattgtttattcttctttccatttccttgtttaattttcgaattgactttttgtcccttatcaaaccccttcttagaaatctgcaaatttactggtacttttattttataatacatttcaatctaaactaacaaatctttcagttataatgccccatttctcaagcattcatactatctgaagtctaactgtcttttaaatttataagcaacagataacatgaggattggacctaggaagagggtggcaggaactatgtcaaatttaaccttatttcactttcaccttctcttttctaacgtttctttcctttatctctaacaccctgcccccaaccaagtatgtactgttcaaggctctctaccacagagctttgtgctaggcatgaccttcctggcaaatatcttatatttagaccaaactttcctatttccgtccttaagagttacctgctctgcgttacctgttctcccagggaccatgacattttgttatgcaaaccaatgaacaatttcatagtgttaatgaagccaacactatttatatgtgggacaatggcttaacctttttgaagtggttttgttttccggacagggatgaaaatttaaccaaagaaatgactatttgaggctggaaatttcaggcattgtggcaggctatacaggaagacatttgtggctggacgaggaaggagtcttcatgccatacttcactgtgcactatcgaagtgggctcctactccacctgcatgaaatcaaacatgtactaacagtgtatgaaccaccgaacaagctagatatcctggccatagaggctattgtgcctcagggccgctctagggcaaccacaagaacagataattgggcctgtgagctgacaaatcaacttgtacccacaccattaagcaactgtaattcactctgagtctagcagagatcccattgtttactgctataaaataaactctataaaacttataaatatggagacagaatttaacataatgctgcatagggtaccttatatcacagaatactaataaaaacttttatattatagaaatacattttaataatgttgtgcttaagaataattatactttgaatgattttcatgagaggcatctttccctatattcacttcaatattatgactgggttttctcttctaacctatattaggttaataaattacttggattttaaaggctatggtgaattatagacttaactaaaacatggacttctaaactggcttgcatgattccacattggcagaatttaactgccattatgaattacttgttaattatgctatttacagtttatatgcatgcttgagaattttaacatgtttagcatgtttcacttttttctgcataaagactaaaaatatataggtttgtgtgtgctgcactgaatcatattttaaaatagaaaaagtaaagaaattaatgtgcaattttggctattgtttgcatggttgttaaaccataaaagataaacaaagtggagaagaaatgaaagaaaaaaactcatttaagtataactaagttgtcaaaggaatagttacaaggcttataactgagcccgaatgttcagcattgaatcaaaactttggaactggaagagggtttttcatgtatttgttctagtgggtcacaaattcaaatatttacatgggccaggtaaataacataaatgaatgaagtggctcagctatgacaacatggattagtagtggctgtggaaacccagagagtgcatgctctgtctcagagggatcatgctgctcagcttcagctggtttctgccctatgggagcacaggcccaattttgctggacttttcaatactttgagacaagctggaaaccaatacttctatatgcagctttttacttttaaatgctaataactaattcaatttttaaagtgttagtatctgtggaacatatagggtacatgggatgtcagattaaatctctgatgaagcccaacagaaaggaattgtacagaaaagaatatggaaacatatactaagtcacttacgtgctggccacatgtagtagaaagaacatgggatttgaactcaggcagatgcaagttgcaattctaactctgtcacataaccactaggtaatgttaggcaagttttaaaaactctctgagcctcaatttccctctccttaaaatgaagataacaatacctgttgcataggatgcttgtgaagatttataaataaaagtaacgtgtgggaagtgcctatggtagatcttggcacctatgaaacatccactctttttacccttttccaccagtctatgtgcctaccctgttttattatttttttcaatagcaattctatagacttggaattatattatgctccacttcctactagaatgtaagtttacatgatggtaagcaatgtgtctatttcttttcactgctgtattcccaacactaaaaatactgcctgacccataataggtgttcaattaatgtacgttggatagatagattaatgattttaacaaattttagtacactgactccttccctttaatgaataaacacacacaagtacatatacatatatgttatccaagctcataaaccaagttaatgctgtactggaacttgaattcacatcaagttatttcgctatgattattttcattgcactattaaagtctgtcaaaattatgcaatgttctacatggacatactcatctcttgggattatagaaaatacaatctttgaggtatttgaatagctttgcaaaggaagtcttcctcacacttccactgactttggtggttaaaggcacttgcagtgctctgtggattattctaggtttttcattctgacaaaaagactattaactgcctttgtaaatcataacgacaacaattttacatatatctggcatattatacttaaaaatactgtaaaatgaactcataactacaaatgtcagttgaatctcacatcaatcttttggggtagatgggactggaactattttcctcattttaaagagatatcagagacacccagtgataaacaccttacctaaagtcacagtatggataactaaaaaatctggcaataaaccatagttctaaggtgatattttatattcacaggacctattgaagacttcccactatagccaagacttctgtattttacaatctggattttttcttcccctccccacttacataaaaactagcctgtcctgggccctatttctaatcctgctacctcttatacttgtacttggtattaatacaacaaactttactggccagagcccactgagtgatagaaaaataaacaaaccaaggacctgccctcaagagctttctatcatcagtgtaacacaaatatttagtctggctaaaatatatgtcccttgtaagaagtgttatgccttaagggactatatgaggggggaagagagaaagatgctggtgctaatctaatacagtgcttctcaactcggcatacctattagaatcccccgaggagctctggaaaataccaaagcttggatcaatctagggtggagtctgggcagtggactttttgaaagttcccatagggatcctaaggtacagccagtgttgaaccaccaccagtctaaatggaataaattgcactgtagggaaataaccgaggaaagcaaaagacaaatacctaaagacaaacttgaccttcttttcccttgtaatgccatttaattaaacagatcttaataccaattatatttacaagattttcattgaggctgtagctttcctgagacttaatctccaatgattttaagaaaaatattttcctccctcaaatctgacaaccagtgtcatttgatgatgatgtaaatatgatcaattttatactaacttacaaagtttggcaggtgaaaacctaagtgtatacacaagcaaatgaatcaaaactgaaataactgtcttaatttttatgcataattcaagtgaaacttggtttatgtcctgatttctctgcattgcccattttcttactttagtttgtttttatttgggatggcacttgtttacccttctattttcagctacaacctaggtttgggttcatccatctaagttattttggtttgcttatttttacctcttacttacacatatttcttttctttttcttaaaaaacctccatatttttcatacattccaagtttcctagaatagtcatttccaacatactacatcaaacttagatggaaaaatttgtgagctcggtctaataaaaaggaatggcaattccttaaagaacatctgtacagattgaagctaattagagacacagagattttatccaatgatgtaagtgcatatagtcccttcagccttggaaactgactcaaacaataggttttcatatttatgtgtgagatgtgcctctttcaaaccttgttacaactttggcacattacccatctgatgtgaacttagatctttttaacacttttatgtttaacataaaaaacaacgggaatctaggattttgttgggaatggcctgaatgacttccttgaagggtgaaattgaagttaaatatgtgcttatccaatagctatagtaatatttgtatacctttctctaccctctccaacctgtccagtaaatcagtaccatattaattgtgctaaaatgccccttaaatgaccatgctatgctcccacctttcatcatcacacgtctcccatttcttaatgtattgtattcaaaacatttgacttggttttcaaagtactttgatactctggcccgacctaacttattttctattgatttcaaacatcttccatgtcaatcaagctggtctcctgttgtactatataaataccagggtgtttttgttttgttttgttatgttttgtttgttttttgccttcctctgaattgttctcaatgtgcatagatttccttccttttctcactcttactctttaaattcgacctgtcttatgcgttataggatgagttccaattcttttctgaagactctcccaatctagtgctctaactgatctctcctttttctaacatcctaaaatactcaccctccctcgaatgtggcatttgattaaatatagccttgtcactattttagttactttaagtatgtcagccctgtaaagagtctgaggggattgtttatgcctgttctaatatatcctccttgcttctaacttggttctaggcatatggttaaggcataataaatatttgctgactgctaactgatgctggtgttgcctagtagcctgggcctatacacactgtcagttctgtcaacagaggctgcgaaaattctaccagagattatgtctgcacaaaaataagcctctggcataaattgcgatagctgccactagagaattcacctgcaggaaagggacctcaggcatattacctggtgctcccagagactcttatgccaggttttccactgtcaaaatacagctaaaccatgtgctaatgtagtgatgtgagtctctccaataatttactgtaaatttatacttgcttagttttctgacatggctttagcatcctaatttcccataagctatgcctcagaattactatggattacaaatttgtggaaaaattgggcatactctgagagtcaaaaattagcattttaaagaagcactttattttctgtaaaaaccctattttcaaagttaaatattctattttattctgaatgagcaaaataagcctaaggtttcagagaaaaatatattcagaaggtaaaggatttaattccaagatctggaactgtgaatcctttctttgaacacagcctctcttttcttttactcctttccccactttaattgctgtcacctcataccgtaacctctatttcccagactctgccgtactctccaagtctctttatcttgcttcttcttccccgctgccaccccataccccgcacagacatgcacagacacacgcgacaagcatacggcccacccacctccctagccaaatttcaacccatggtcatacaattgacactttaagaatgtatttctttacagtctatattgtcttgctccctagttcttccattctttttacattgacacaaagtaaaaattcaattgaataaacagtagcagttactattattttcatataacactatcagaataccaacttttctgcacggtgcattgccttactgaagtccctgaggacactcatgatgaaagcccttaagctcacaccattcactcctctgaggctctcactatatctttccaactgtgattacacattcattttatgccccctttgtgtaccgaattgatactcatgttgcacctatacatctgacatcttcaacatgtacccaaatcttttatatatgtgcactttttctccctcacttcatcctaaaggacaggtaacttgattccttaagtgttaaaatggtatgcttgcttcttttgtaccttaccatgggaccactgtaagggtcctgcacactgtgggggcttgataaatgttatattgagagtcaaatacatgcctgaaagaatccttttaaagctaaccctcaaatacctataaaatgcccaagggagccccacagaggaataggtgagacagagcacagcagagcttattaaaaacgatctgggcttgcaatacaatttcttttagactggatttttccttaggcttaagacacgtgctaattctctcagctgctttaatcatgtagatattaaacaatgagggggcatcaaacagtcttttagagttatgagaagtgcatgctatgaatagacacgagggaagatgaaagccaagcatgtggcgactggcagtcccagcagcaggtgtcttgactgaggacagaccccaagatctactggaaaatgcaaaatggagaaacccaacgctgtcagagaagaaggcttcaaaactcaatccaaatcaaagagggctgcagacttttatggaggcttttaaaaggaaagtgttaagtttgtctgaattgtaaacagaatccatctgaagatgcattttcccttaaaaagtcatcccaaaacacaaaagcaaaaaaaaaaaaaaatcaacaatcacaacaataacatttcaaaagattctaaaaggagggagggttgacagccaaacctttttttaaagtaatggtagccaggaaagaagacgatgggttgtaagaattcaccacctggaaaagagagttacctggggagtgacagctgccataggaaaagtagaacaaacacacctgctgtcaggcacacctgttcttttcagggagaggaaccatgaggctgaaacagcagaaaacgcccaagaaaagggtaggatgactcttgcaacccttaaatattttcccttactcctctggagttatttcctcggcaggaatggatgcagagtaaccacataagatttcacctaagtctttcaattttcatagtctctcaaattcctcttctagctgatagaaagaaattccttaaaggccccaagagagaagggaggcaaacattttctgtggcctacgctggagaaagaagatacactattatgtgctatattaaaatgtgacttaaaggtgttgaatctgaggtggcatgaagcctactgggactggtaaggtagacagagattgtaaggggagggaggacgccaagcgcacgcacacacacacacacacacacacacacgtacacgcacacacacctgccaaaaggccttacttccccatagtaattgtttcgcctttaactgtggatgctcacttaagaacatgccatcatttctggttccacaaagcggctacctggtcattgatgcttgcaaaagtcgaattctgggcttccacagtagcccagagaatatttaaggccaatgagaataaatcagaccaaaagggcaagatagctctgtagcagattagctatactagctttgtaaacgttcacaatgccctacaggaaagcctgctgccagcagataagccaaactagagttcaatatcagtggcaatattttgtcctgccttgtaaaaaaaatgatctagcaagggatgcaactaattgaggcagtggcaatagtgagatagaaggaattttaaatgtaattcatgcatagtccataaatggactaaaaagtacagtatttttgagtacctactaggaactctatgttaggtattgcaaggaattcaaaagacctctataccaatacaattaaaagtatttgcaatccttaaggaacttaacatttcactggggagacaatctttacaaccagtgcttaagccagtaaatagtcaactgcaaagctgtgaatgtcagacaataaaaactggagttcacagaaggcagtgagcaatatatgtggaagtcagaagttgtgaaggaagactttatcaaagaggcgagacttgagttaggccctgaggatgaataggatttggaaatgctagaaagaatccagaaagaatgtatgaaactaagatgcaaaggaaatatgagattccaaacatgaccttcagcatgagtctcagttactatatttacccttgtgtgtaagaatcagtgtattcttattaatgtggaaatgtaagtccctagggattcaagtgaaataaattaccaccaatttacatggggtttttctaaccttgcacataattcaaacggaaaaataaatttttaaatttttaccttaattaaatttcaggcatctctgcatacttaggtttaagatcacaatcagtactggaataaaaaatcccaagagttgcctctgaaagggttccacagtcaagtcactacacttggtgagttcatattcaaatcaatcataaattctattttaaaataatcccaggagtaatcttaaaaccaaatcctccaactctatagctccaacttttgattattcatgtggttgtagtagagaaaattaacctctgcttttcatgaagccctacttccagatttttatgctggggtagcagtattaaccagtttgtatttcacctttttcagctctccacactgccaagaaggtgttaatgagcagtgaaaaggccaaaaggccagcagccaaaggaagaaaggcacacaaaatacaattgggaaagccctgttccaacaacccaactttgtgagcatttgattcaccagtcaaatagaatatgtccatgagttcaaagagtataaataaatccaaagatttatcaagagtgattagaacagtcttgagtcatttctcaacttacagacaatttttaatgcagtatttcaaagtgcactttaaaaggagggactagaaattatccattgttaattttagaaagacgtttaaagtcctcgttaatgttctacaaatccagaatttgttaaaatttcgacaggctttgttagaaatttactattagtgaaaaatgtgcataaaacaaattaatttcaaaattaaaatttggagaggaaaagcttaagcttcttaaaataagcttttaaaaagcactttaaaggcatacatttacattccaataactggtaatcattcttatctgttcattaaagcaggagtcaaaggatctctatttggccacactttatttacccagtttaaattccattgcattttaggaccatttttgcatattctactctataatttttatagagctatataatattacttgtactattttgcacaatttattttccacctagacattttcacattttatctcatgtttttattacaaagaagaatactttgtaatacacacattatatctttttatgtgcatatacctttatatatgtgtatcaaatgaaatgtgtgcatatttgtgtatacatgtatgtggattacatattttcaatgaaatttgggagcttttgatgcagactgttctatacttggttaattttgtttaacaatataatgtattggagatatatctgtctacatctttctcaatggctgcatagatggaagaatttattttttaaccagtcaccacagatggagatttaaagcatttccattttgtttttgtcagatattactacaagtgtcctccaaacagactgcattacatgacagtgcctgactccatgcattttagaataatgaaaatgcaattcttactaacatattcaaacattcagatgagcttattctcaactggtctaaattagctaggtcctactatacaatactttgcttttggagacactgctgctattgtcatggcatactctgccctctttgctaaagatttcagctcctttatattgtgtatttggcatttcagggacagaagggaaaggaaaatggattatgttctctccttttgtattcttcttgactactgcctgtatggcttgtgaggaactgcatttcttagcgtgttagaaacaacggtggcagaacaggtaggaaaccagtggtgcagcagatcagagtgttagtccggcagaagataggagcagtagaaacaaaagggctataagataaccaaatataattgaattttgagtaatcaactctttcatctttctcccaaaaccccattggtttgcccagtggaagaaaatggagccctataaatggtttaggaataaagagaatgtgactatgaacattcttttgaaagattatattttaaatatctccctgtatgttacacaaagctgtttaattgtataggtatcacttattgaaagatcgtttcacattgttcactgtgaattaagtggaaaataataactgaggagagttgagaacaacaaaatctctctggaaataaaatatcctcttgtaacaggtgggcaatttgaaggattaaattaatgctttggggcaccatttagacagtggattgacagtaaacttacaatatttgaaaacaaaaaagttatagtagaattattgatgatttggacagttcacttctccctgagtccaattccctttctgtaaagctaagtggctatactagatgatttctaacagctctttcatttcgatgattctgatattatggacatatttaataataattgtaataggcataaaatattctgtggccagaaatattaagatgctcacttttgtatttttcttaaatccactattggtacaatttttcctaacacagccttttgctcctctgtgcctggctagattttacttttgaacttaactcagatgtcatatcttccaggaaactttccccgacccttctaaccccttatttgagttagatgttcctcctactgttattatcacactgtgttttaaattatctgcttttttttcagtctccttatttgattataataaactcctttttggcagcaactatgcctttgcattcccagtgcctagcacaatacctgcgacatagcagagacccaacaaatgtttaccaaatcaattaaagcatgacattcaaacactcatgtcaataattttttacagcagaaatatctgaaattgctacatcattggctggtaaatgcaactgcctatttatattcttagatgtctcatgagtatctaaaaatgaaaatatttaaaacagaattcttgatttctaacctgaaacctattcctttctcagttttccggacattagtttcctccaccagaaccctgactgattcctgattcttccctcttcctgtccactcaaatacagccctgaacataaggtcctttaggttatatctcaagaatatatctcaaattagtccacttgcctctagcttcacctcttgcatggacttctgcagtaacttgataactgatttctcttgttcctttttgtattccccatccattatccaaacaactgccaaagtactcttttatatatgtgaaccccactgctgcccctgattaaaaccaatcaatatagtcccattaccttaggagaaagtctaaaatctttggcatagttttcaaagcccttaggtcttgtctccacctgactccccaacttcatcatgtagtacattttctctccctttctgcaacataatcacattggtttccttacagtcattaaaacacaccaaactctttcgtgccttatagtctttggacatgctgtttccccttgcttggaatgctcagtccctggctcttcacatgctccgctcttccttatccttcttatctcagcttaaagattacttccctggacacactaagtagatccctagcctcaccctgttatcttctaagaatacactctgttggtcaccatagcacctcatagcactatttggtatccctaagtagtttatcagctcaatgaagacggggtatatatttgtttcattcaccactgtactcagtgcttagtactttgtctggcacacaatagatgttctctatttcttgatgtaacactaagcaaatgcaaaataaatactaagagtgcaatgacaatgctgtactgttttggtgcaaaatcaagcctggttaatcacagaggtacaatcttgatgaacagatattcagtgcctattcacaattcttaaaaagtagtataactaggccgggcatggtggttcacacctgtaatcccagcactttgggaggccgacgtgggcagatcacctgagatcaggagtttgagaccagcttgaccaacatggtgaaacctcatctctactaaaaatacaaaattaactgggcgtggtggcacatgcttgtaatcccagctacttgggaggctgaggaaggagaattgcttgacccagggaggcggaggttgcagtgaaccacgatcacgccattgcactccagcctgggcaacaagagtgaaactctgcctcaaaaaagaaaaaaaaaaaaaaagtagtgtaactattaagcacttatccacgatctttcagccgtaaataaatactggcaaaaaccactaaagatattcacccatttatttactcatttattcaacaaatgatataataatagaaaatcaataatgactataactatatagagatacactgttatcataaatgaatggattcgattacaaacaacatggaacaatcagctaatttcaattttttgaatagttatatttaagtgcctttaaacttccccaaaggcatatgtttatttctcctgtctagactctatacatagaggatagggtccataaattgtatgtttcctgctccaatagtgcttattgcaatgctcagcaaataaatagatgatgctcatctaagtgcttctccctgtatctgtaccaacatagaccctgagcttttccataacaaaactcatactaagatccaaaagaagatactccctgagaaaggaaagagaaaatacagataagaaaagaaaaccctaataagagctgaaaagtctgtcaatgatgatggacagaaaaacattagaagaagcactactacgcagcatcagatgcatatatttacatttaatttgagggtgataaacttagcaccatacaaacgatgtttgtttatgccttctagtagcttactatccaagatactgattatactgcaaggtacataaataatttaaagggctatttttcatcctgcctcatatagcaactcgatgggctatgtcattgcagtatattatttgttattgaatttcctcattttcatttgctgagctgatttttatcaatattattacagcttctttttatttatagcttctattaatcttgacatcatattgcttgcgttgaagattggtctgaagtgtttctattaaaattattaacatttttcactgaaatttagccaaaatattaaagaaaatacattgtaatataactccatatatgtttatgcaaagagcaacataattcaattcctgatgtaaaccccaacaacccagtctccttaatataataaaacacgaatacaatataaacctataaatgtctggacatgatgccatttctgaaataggatagcaattaggtaatatttggccagagaggaaaagcaagatttttggaaattatcctcctaaagctataaataacctgctaacaatttcaattgaagttcaaattataagggcaaactggccactcaaactgttttccgtgagaaaaaggaatttagaagtgccttcattgtttttctgcctgtgtgatgtcaaatatctgcttcatttaaacagttgaacttccacttggttgtttcaatatcacataaacattgcctaaaaatgatttttacaataagaaagcctgtgatatgtggagacgactactgcaattttaggtttcacaatagccacagtaaatgatttgcctctagcaaatccatctacttacatgccagtagaggaacatggtttaataaatctgaattggctctgaaatgggaattgcataaggatgacaatagtgagaaatatggtaaaatggaagaactatttttgaaatctcttttcttcatgcagaagactactgagagtttctagagttgctgaaaagggtagaaactacatgtgtggatttcttagtgaacataatctctccacagattcctggctaaatagtaaaactgcagcattctggtgagtaattgtatatacatcgatgctcaaatgaaggcactctgtagaagttgtatgcacaataaatcaccatctgtacttggcccttggagtctatttgaatgcccattcagtccaagctggctggctagatatgtcattgattttcttcttcagtgccatccctgggaaaaaagccaatgtttaataatggaaaagatcacaacttaaaaagggaggcggggagatagagtatttttgaaccccaatcagcaagtttttggaaactgggtacactaacaaggtatttatggacttaggttggatacaaataaatatataaaaacaagtattcatctgaataagaaaggacattacaacacctttgactaggaaatcttactccgccaatgatagcctatgcttatacctattggacttcctcatggccataaaacctacttttcaaccttgacaaagaccacaagattgataaccttcttttattttcccaatcagtccctctcctaacttctgctcttttctatggtggtctggaatccaggatcagctgttttaactagtctttcaacagcattacctctgccttctccctcatgtttctacttgacctatcttatcagtcgaacctccaagaagttttaccttggtttccactgtttctgcacctggactgataagaaaattaaaattactgtatttaatatccctttcccaggaacgtggccctcaattcgaatgattactataagaaaaggcacttgatttgactggataaatcctaatagccattccttacagtggcttcaaagtcctatgtgatctagctcctgctaacttctcccacctcatctcacattacccttctcttcactcactaagatccactcacagcggccctctttctgctaattaaatatcccaagcttatgtatcagtcagggcttttgcccttgttcttccctctgtctgaataatattcatccaaatcttcaaatagttggcttattcttgtgatccaggtgtcagctattcagacttccctgaccatcaaggctaaataaagtagaccctactgccagttactctttgttataatcctgttttaattttttaataaaatatatcaatagccaaaatatattgtttattatcaatctctccttactagagtataagctcttaaaagtagggaccatgtctatgtttttcacaactctatccccaacacctaaaacaagatctgaaacattgtcagaacacaaaaaattctcattgaatgatggactcaattgccacagtcatcagttcatgtgtgaacatctgacctaagctttgtcaatcaaagtacattctgcaggtcctacccctggccacaagtgattgatgcaggagtgggcaactgaacaaagcaaggctaatcaaagtccttgcttaggattctaggtcttggacccattaaatacactgcttctatatcagggtggtaagaagagatggtcaagagcctgtatgagccatgtttcacactttgtgtttactaagcctgtgtacatgaaagaaaatgaagtttaaattcaatgcccactagaaaaatataaatactatattgatcatatttgattcattagctccagttatttcctatgtcagtcatatccttgccctttctacagtttgctattctaaactttcttttgttccctgagccaataaattcataccactttttgcttaagctagtttgagttgactttctgtcaattacaaccgagattctaacttatatactaactttccctgcaaccctactaccactttccagatttttttctgtctcattgttcattctgctaatgtttcttactctactcacagccctctctccctgaatcttggcagacgacattgtctcctacttaacatagacagcagatgctacgagacatgacacattccctcaattatccctgctcctctcatgtttcagagaccaaaaattccatctgtattctggatcctttatttaggctttctccaggaccttgctccatcagatactacctctcttttctatcacttaatattttttcttcattagttcattttcccttgactataagtattcattcattcatacttcaaatatttattcattgccactgtgggaggggcaggactaggttaatgtacatgcttatgtttcttttccatccaaaaaaacaaattaatgagacaacaaaaaaattccttcctaaaacctgtgttctcttttagctattgcccctctctccttgaccatcccatcacttctcagccaagcatcttaaaagcctatacttgatgtctccacttccttttctttgcatttatttatcaacccactgaaatctttcttatttctctactactacactaaaaatctcttttttcaaagtcagcaataaactcctaaatgccaaaactggtaaatattgtagtctttacttaacgagacctttttttcatatacgatactgttccctctttctggattatttgttctttcttgtcttctataataccacttgtcttgaatttccattagtccacttctcagcaattttcctgggatccttttcctgtcagtcatttaaatgtttagtgtgctacatgattttgtcaattgcctcttccttttatgttttctactctgtacatgctcttccagtgtgatcacaccagtctcaaatatcagttatgtatcaacaatatccagatccattttctagccccagtactccaagtcttgtatatctaacttcaaattagatatttctatctggagaaactacagccctgtgaagtcacgttcaaaagagaatcattatttttccccctaaaactctgccttcttgcttccctaccttcctttgttgattgctagcaccatcctcctctttaatgacttgccaaagatagaaattgtattagttcattttcaagctgctgataaagacatacccaagactgggtaatttataaggaaaaagaggtttagtggactcacagttccacgtggctggggaggcctcacaatcatggtggaaggcaaaaggcatgtcttacatggcagcaggcaaaagagaatgagagccaagtgaaagggttttcctcttataaaaccaacagatctcttgagacttattcactgccatgagaatagtacgggagaaactgcccccatgattcaattttctctcactgggtccctctcatgacatgtagaaattatgggagctacaattcaagatgagatttgggtggggacacagccaaaccagtttttttcagaaatctttattattttctctctttcattgcttacaaccagttagcccctaagtcttgccaatttaaatttatctcctatgtatgtctcccttttagaaaatttggatatttaatgcctaagttaagctcctaatcatctctttctctagattattgcaacattttcctaactgatcactttcaacctgtctttcacgcttctaatatatccacctcattgcctacagaaacgacaaaagttttgaaatcctccccactggagaggaatgtgcttaaagcacactaaagttcaccttgaagattatgctttcccccccgccccgcagggctcactatgaatagttccaaaatgtacctttgaatttttcacaattattttgataagactacaattaaccaagtaaagtagaagtctattaacagtaacaggaagtcactgaatactggtcatagcattgggcagagaggtaaaaaacagcggagaaaaagaaatggtaatgtaatttagaggagaactaaattcttacctgcctttttgttacaatttgtctattgctagggttcaaacacttcttctgaaccatgtcttcatgtatatcatgctcaatattatattagcatataacttggaagtcatttctgttctttcgtatctcaacacaagcagataaagacatatcgccagttttattatttttatttcaaatagatgtcttgtcactttctaaggtctgttcttcaaatgaggaattataaagaagaatctcagaaacgagcatttcagttttaggagactaaggaggatcagacaggccagtgctgaaaaggaaaccatcacacagagatcttgttgattatcctagcaaatctctcttttcattttacttttcttctttggttcgaagattctctctagaggcagaagggagggctgtacatttcaaattatttttaggtctttgattaactgtgccaccagaccccaggtgactattaatatactagtaaaggcggttaaaagaagacctgaggtcattcagtgagtgaaagaagcaaaattgaaagcatgagttttgacccagtgatatgatctttctagtagaccacatagtagaggcaatccaaaagggggcaaatgggaataagggacactatctgcacaaaaggttagaagacaaagctactcagcatggaattcagaattaaaatgaaagaacttacctagtgaactttcaattcaaccatatctcaataaagctcaatcctattataacacagcacacgattataaggctacaaatgtactgcagagaaaatcctgtgtcttgaaaaataaaagctcagtaaaacaaaagccaaaataaaaaagctatcagttatgcttctcaacatgagttttataaagcggtgctgctgtattaaatttttgtctgtgaccaaaagaaaatttcttgaatagcaaatgctccataaatgcttgtccaattgaattatctaattggctaatgtcaactttttaatatttaaggatcactggggattatacattgattagctaacaagtacttcttatccagagaaaactggaagctcatgccatagcttactaggatttttgcaagaggagacaaacagtcataagattgctgttaattatgtttccacttctcatgaattgtttacttttattatttacctatgtcttgaatggtattgaagcaagccatgtaagtccctttgtcaactgccagaagtataattctctacaattaatcagtaaaaagagaattaagcattgcttctttagaattaggaaaaacctgctgctgataaattgaatgcattaagaaattaacataccagtaaatgattgatcattacaattatctgaatttgcatttctagaatttcactgaaagaactcaaaatcattcttttaagatatttttagctatgtttcccaactggatgaagtataaaagagatatcctgcttattattataatgataagttcaagagtcttttaaacatgttcacaactggacattaaataaattaatccaatatattttaaaataggaactcatacaagggtttagggtttaccagctaattttttttattatctaccctgatgtataaaagaaaaattcatctgtatgtcatgaatcacaaaggcttgtaagccacccaactactaagcatcctgattaaaaagctggagaagagcaggccacttaaataaaaattatttggcagatgcaaacatctctatacaggcagctcataaaaatattactgaggagtaaataaaatagggcaatatcatctaaaatataccattctcactcagagctgaaagtaatagcttttgtttgaggacaaacaacaacaacactaataataagtattgataacaataagcaatattgaaagataattatgtgccagacattattttagtattttgttggtttgctttacttaaataaatatttaccacctggttagtgtgtcctaggcagtgttcaaacactgggactcagcaaagaacaaaatacaaaattccttgctctcacagaacttaatctagtatgaaagacagaaaacaaatgaatacaataaaaatatactaataagtataaatgtatagttatacatatttgaacgtatagtacagtaaatatgtatatagaaatataaataaatatgtaaagcataaagagaaataagcaaaatagtatgtcagatggtgataaatagggtgaccataatgtctcagttttctcagatagtactggtttatatgtgtggtcttagtgtaattactcctagcacaccctttcactctaaaaaatgtcccagtttagacaataaatcatatggtcacctaaatgataagcactatggaaagaaaaaagcaggaaaacaaatgtgttggaggagggttgtaattttcaatagcgtagtcagggaatgcctctctgagaaggtcacatctgggtaagaacctgcatcaggcaagagaccgagccaggtccctatccaggtagatatcaagggaaagaacatttcaggcagagggaatagtgattgcctatatttttcagaatcacaacagaatggttgtaacagaatggttgagaaagagagtagcaggagatggagtcacacatggaaagggaagccacattatgtaggtctgtgtcctcagtgagatggcgagccatgccaggttttgagcagggaagtgataggctttgggctttaagagtatcactctgactattgtattttgagtaaattgtaggggtgtaagagcataaaaggagagaaatcagtcaaaagcctattgcaaaaatcaatatgagaactgatggtggcttggactagggtagtagcaaaagaggtgatgataattagtcagattttggatatattttgaagacagagatgacaaggtttgatggtaaaatggatgaggtcacgaatcatatcaaggtttttgatataaatatgtggacataagagttgccagaatctgagacagaaaaagtcggaggagcagattttgaagggagggtcaggagttctgttttgaatattgtctcagcttggttttcccaaaaagcagacagtgaaagaagggattgtgtgtaggaagtaaattttggaaagtgatccccaaaataagaatggaggatcagtaaaagtgaaataaagaagtgaggcaagtcaaagggtgagtttttgagctggtcacagctgagagcagctgaagcttgatcttacagggcaccctctgaagagcttgtaaaatgcttgggagaattgtctgctcaaatacaaaagagggaggcagtcatgaatgattctttctcttctagatcaagggatgtcccatgatgtgttaaccctctcacacttccaggcttgcacatgcctcagaatggctgagtgggttgctacaggcattccacatacaagtagcagaaaaggcaggaatgagagctatctgatgcagttgaaaaaaacgtgttgttagtgtatatctgcatgcagctagtaggcgcagcaatagctggaataaaaaggtggggtgaaaatgcgaggtgaatcagaggtgtccgatacagatatgttaagtttgagatacgtatcagacatgcaagtggaaataaaaaataaccagctggatatatgaatccgaatttcaagggagaggtcaaagctggtgatgtaagtgttttctgtatataaatgatattaaccgtatgaaagaggatgatctgaccaagggaataagtgtagcaaaggtaagagaagaggtctgaaggctggattctcaggctgtctgatgtttaatagttgggaggatgagaaggatccaataaaagagagttagaagaatggtcagtaggataagaggaggctcagaatatgatatcttgaaaaccaggtaaagaagaaacagtgaatgatcagcggtgtcaaatgctgctgaaaggtcaagatgaaaactaagaattgaccattgaatttagcaccatggagacctcggtgatcttgacaagagctaagtatttcaagaaactctaagaaaaatcattaacctaaatgttgcgtttcctgcaaatagtggtagggaatgaaataagaaagaccacgatgcaaaaatcaaacgctgaaaaatgtctgtaagtctgaagattgacaaaccaccttaatgaggtagaaggaaggagaaaacaatagtcagatggtatgaactttaaaagaagtgaagctgtaaaactgaaaaaaaaaaaaaaactaaaaagaagtcactctgagtagacttagttgtcaaataatccagtgaacaccttggagtaaattggttatcattgagtaaattatttttggctcagttaattcagctagttagttcatagtgttagaaagagagaggtcaataatttgatcttcaccctagacagctcatctggcaaaggaaagaacactgtcccttggccatggcatacacttcggtcttgcacagcaatcttgcaaattatattggcctaatgctaatcatagtggatccctgacattaagtgcagagggctcagggtataccattccctattaactaggaaaaccatgcagatatttctaattgtatgtaaagagcatcagctctcattatagacccatttgaacaccaatgactatattttatgaatgcctttctacatatacattacagtatattgattaagggcatgatacttagtgtccagtagacatatgttcaagtttcaactgggctgtttactataacctccttctccatgcctcaatttcataaattgtaaaatggggattagaaatgtggctaaatattacagggttattttaaaggttaaatgagatcatgcttaacacagtgtctgacacataattaaagatgagctattattgttctttaaaatgggtaagcacgaggatttacttgctgaagtataatggtttacaaggtcccatcctgctgtcgttgttattctagaagcatttttctgtaacagctttcaacttcattttaaacttgggaactcaccagagactgatttttgttttgtttcagctgttcagaagtcacctatgaagttaagcctcttatgtggattaagtcaatggcaatattgatttatactttttatgagctaccaattctagttatcctaacctttcaaggaagaaaaaaaatcccttggaagattagaaactctttcattctcactctgagtagacttagttgtaaaataatccagtaaatgcttagttaggaaggccatctgtatcataaagagcaatatttccatttattcaaactacaacatcaatagaatctgcctcccataatctagcaataaaggacactgtttggactaatttgttcaaaattttaacagttcctgaacttcacaataaaatgatccactagtatgtacagaatttttaataaatatggctatgtaatgatagtaactgaagtaatagttgttggtagtaattggatcataaaacctttcaaatgagtttgtggcatgaaggcaacagagaacgtgatgaagaacactatggggaaagactcatctgctgttgaagattcactaaaactccatttatggggtcaatgccatcaggatgtattagagggagcacaagatctactgctgagctattttgcataaagtttacataatctacagtgtacaaaagccatgatgctttaacaagttgtagtcaagcaagactcttctaaaccaactgattaatgtgcataaaaaagataaatgttaggaattttattttaatcaatactctttcagggtttaaaaattgtattatctgatgttaattgtgtatttttgttgttgttgttgttgttgtttttgagacagagtttcactcttgttgcccaggctgaagtgcagtggcacgatcttggctcactgcaacctccgcctcctggcttcaagcgattctccagcctcagcctcctgagtagctgggattacaggtgtctgccaccatgcccagctaattttttgtatttttaatagagatggtgtttcaccatattggccaggttggtctcgaactcctgacctcaggtgatccactcaccttggcctcctaaaatgctgggattacaggcgtcatttttatcagagacattctctagaagatttgaactgaaaacaattctccagtgtttcatagcagcttaattggaggtattacaactgtagttaccatgataggactaagaattttgttaaacctgtttccactattgctctatttctataccatgaagttacagagcaagggcatgggaacttaagatcctcaacaaagtccgactggctggtgtggagataggattctcccttattcctatgtataaagttccaattcattctgttatttacagtgacacaacttactagatcctaagtatgaagagaaaatctctctctgaaaatggctgaaactggcaatctgtgtgttaaaagcatctgtgaaaggatttgacaatcaggaataattcttgtgtcctggcacttttcagaatgatttatgtatacaatttccattgatcctctgcaccacagcgaggaaacatcctcactttacataagtggaaacaaaacgttgtaaaagttatctcattataagaaaaaaactgttgagcacttactatatgacagggtttataaaagtaaataaggcatagttcctgacctcaataagtttacagtctaggtggagaaacaaacaagccaattacaattcatggtgattagtgctacagtagtaataagtacagactgctgtaggagtatacagcaggagcatccacccaagattgcacggcaccaaggcaggctttccagagcaagtagtttctaggtagagactctaatggagactcacaggctgagaagtacctagccaagtaaaaaattagaggacaatcccattacaaattgatccactttattgttccttcccctagaggggaagaatgggtttggaacagtgtttcagtcagagatgagagctggtgcaaatgtacccaggagtatagccaaatttggatcaataggaataattttatcagatccaaaaacataaaagaaatgaggtgccatgcctttaagattggtaggggtatagctgaatggcatgtaccatgaagtaggtttagtattttattgaggcttgttggtttttaacatagggtagaggagtcttagtgctgtagtaaagaatttggtttgtagagcataggataatgaagagtaggctccaaaggcacccttgatggagaaacagtggcctcaggggaaagccatccttgaggcacattgaaaagtgagaggagccatatgagagggttgcaggggaaagggggcccaaggcttcatttattcaactcaattcattaattcattcaggaaatatttcctaagcacttattctgtgatgatactgtgctaggctattaagtaaaagagcaatttgaacccaaattgctattagttcagtattctttctattataccatcatgaataattaagcaacaaatacatcaaaacaaaaacaatcaactttttaattcaatttactaaatgtttgttaaatacttgacctattacgtgcaaaatattgcactgtatcaaagtatctacttactggttaatggttgttggttatactccatgctctctaagaggaaaggaccagtggaattttagtaaaatgtgcttagtactaaatactgtcaaacactagaaaatggtagaaatttcctgatgccttcaaaatcagtgatcaacaaataggtattgaatacttcttttggaaatagtgattgctgagttgaactctggtgagacttaagtataagtagaatgaaagtttatgtagaattataataatgtaggcagtaaaaaatcaacacactatcacaaaagcttggtgatagggctgaaatagaatcaaattttatgtaatttttagctgggtaggcttagtgtggtcctgcctgaaaggtatgttctctcaaggtccttgacagccttgtgattcagttttaagtgctatgaactttggttccgaacctgagtaataaaaactgcataattgttttccttttatagttcccatgttttaaagctttattttagtaaaagtgcacgtgttttaccaaaagaatgactgtgaaaagtctgtttagtttgttaaaaaggcaactttctcaagacactcttgttgaattcggatgtcatgtaagattataaattctactgtgacagacttcacagtattcttatgaagtcacaattctaacaacataggcttcagactttatattgaaatgtacattttaatcccacagtacataaatacatgcaaataaaagtttcaaatatacattttgaatcatcttattagtacagtgcagccacaattaataaaaaaaaccacagaataaaaagtagccttgtttaattggaatatctacatttccattcaccccagtagttggcattgataaaaatgagacaaatatcaaaaatacaaagccacctccaagcttttaggttctcttcatttctacattgaggccattcttcaatggcttctatatctatagtctagtgcaatgaaagtggaagcagctgaccagaataacatccttctgtgtatacaaacaatgttctaaaccaattccacatccaaatgcaattctacaaaccaaggagtggtataaagaagacacatgtattttagaaagcctttagccaataaattttagactaactcttgttaactgcaaagggttatgaacttggacttcagttgtgtaattattttatctaaacttgatttttatgttatgacaaaacatcatttactaaaactaccacatacttttctatgaaaagttaaaatatatatatatatatatatatatatatatatataacaatcaatgtgacaaatagggaaaattctaatttgagtctctttccaacttaatttaccaaaagaaagtgctgttatacatttaataaattaatttgttcaataaatattcactgaatacatattatgtgccaaatactgttccaagctctaaagtaaattataaaatcatggtggcagaatgatggtacagccagcccgcttgtagcttgtacttttaagttaaattgatcaggtatgttccctggtccattggccagatgctttggtactgccaatcatattgcagattcgaaagaacacactgactaaatatcctggctgtgtgttatggttagaatgcttcagaaatcaggttgattgtcctctatcctagaggtagtctgaaggaaaccaataagaaacataaagcttgccaaccactagcacttgacaagcatacctggggcttagagtatgtgggatgggaagctgcaggagaaaaaggagcataagcatccatgtttgaatgttagttgctgctccatataacatctcttctgttttgcctttccattatcatatactagtacatcttgcttaagaaaatgcaatcaatagaaaaaaattagagaacaaccccattacaaattgattcacttcactgttccttatgtatggggtgtgtgtgtgtgtgtgtgtgtgtgtgtgtgtgtatgtgcatctgattactaaatatatgacattagtatgtatatgtattcatataaaacatacaataaaattctgcatttcttgtgaccatctcatttatcaaaaccacagattacttttttcaagtcagtgaaggtaatttttgaccatatttattgaataatttgagacacattagcattcagcctggttgtatgtcaatgtgataattttttaagtgttcttgaaactttggacttcaaccattaatgagaagacataattggactttagtagtgaagccttataaatatctcagttgaagcttgagaaataaatcttaactcaaacctttaaatttcatgaaaggtttgggtgtgtccttattaattatttttgcctttgagcttatttctaactgctttcttccatgacataaaagacacaaagggtcatttcctctaacagtttgactctggtgtaacaaaactaaatacttcatgtgtcacaagaatgactggcaccaaaatagcactgcatatggctcagtttatactggtgggacagaagaattctcatcttttggtataaatgcttcaaatgagaatattgtcaaggtctcaagggattcaaagtttatcttccgtcacctctagaccctttcagaattataatgagaaaaaagtgttgaaaataaacagaacttatttgtatatggagccagttctgcatcacagatgaccaaaaaaagcagaataacagtttgctgacaggatgatttcctgacaggacatgttggcatacctcatggttatgcctttgcagatatttaaaactgcttttgactgttaatatgaaatattgctacatttcaaaatgccatttctgaatcttcctcaaatccttgtaataaaagagaagcagcatgtaatttggatatagttccaataaatcctatgaactgaaaccctccgaggttccctgtcatctactgaatcaaatccatgtcttttcacttcactctttaggtttagcaactgattccttctatatttcactaactttccttttacatcattcttgaacagtcccgctacttcagccatgttatctattgtgttagccatgatatctattcagattatcttactgacccgtgtctctgcctctttgtgttaattatataataaatgggtcctaaagtattaaaagaaaaaaagacaaagctctttttcccagtcttcacagtcccatgaatatgtatcccctttgatcctgcccagtagctgaagtaatttaaaaggaggaacaaaattatgtaccccaaaaaccagttgctttgtttcccaggggacaatcatctatgtgacacttagccagggagtcagtcttttccttctgatattatgtagatcctcaaaagaaatacacaattccatttggtgaagagttatttaagaagaaaacactagaatcaattctcatactatggtacagtttttaatctagatttaggaagaagcagcaaagggttgaacatagaattgagcaaagtgggctcagagatagaccacagaaatagaatgaatgcgcagaggcaagagctattttcagactgagatcaaaaagtcatgtagcctcagaagcagcaagaccaaagaattttgaaactgacctagcttttcctagctaaagaatgtccacaaagagacgtgatggtcaaaggtaaaattacatttgtgtaatacgtatgtagttagctgtaattgtatattgtttcataaagttaatttaagaatatatatagcaaattatttaaatcaaatttagccctactaggtgactcctaccatttggtaataaattggtatctaggaagtgatggactgtcactgactgtggttacctatactcctagctaactgatgaaggggaaagagggagttttacagaaatgatgaccttcaaaaagatgcctgaaggtgcaacatctacactgcaccactataaacctccctcctccatttatccacttttctggcttctttcccttctccaatactgggttccagacttacctgtacaatatatacattcatactcatcagcaaaatttgtaaaatcatttatatgaagggatgtgttgtataaatgtttatataaggaaatattacctctcttgttagaaacaaaacccagaccatctgtggttttggcactaagtggaaaacttcctagttgatggtgacagtagtaaatcaagatgacataatggcaagggagggtgaaatgtaggggcagagtttactgcttggttgcctcccaccaccatgataattatctttacatcacagggttgcaaataaggactaaataaaaaatatatgcaagctcagttagcagagtacttggcacatagtggtcaacaatatttattgtcattaatgttcccacatctccatctacagttccacctcacctgagctctagataggcatgtgcaattctgttttggcctcgtcaaaaacttacctcactactcatctgaagcctttgacttgattcacactttcagcacataaccctgtctctcatttttcttgggtgagaccatcaagtcataaactactttaacttctcaccactatattttgtaatttacttcctgtcttagaggatgcagtgaacattcccctttcaaagcctttccttccaactgagatccagaaacattctccagttgagccttatggcaataaactcatctacattcacttgcactcacccttcaaatccttgtgagttggcatctttctctaatattattgaatattattgaaactgcttattttaaggcagtggatccctatcttggatgcacattggcatcccccaaggatattttttttaaatgcctgagtcccgcccactggaaattctgatttaattggtctggggaacagtcttggaattgaggtttgtaaaactctccagatgattttaatgtccagtcaaagtggacaatctctagtctaaagtcagcaatgaccttctaaactggctgtgttactgtctattatttgacaatattagttacatcttcctgctgaaaagtctcctcctttggcttatgtgatactcattcctttttgttcttctatgacatatcaagaccacttcattgcttctgcccactattttaaattcagtgcttctgagggtaagataattggctctcattatttctgattgtatgtattttcactggtcatctcttttactcccgtagtttcatagaatagaaccacctatttctatttctaagaaaaattacattgggattttgatagggattacattgaatctattgatcactttgggtaatatggacattttagcaatattacatgtctccaaacacatgcataaacagatacaacacacgcgcacgcacacacacacacacacacacacacacacagacaccatttctttaaaattgatctaaatttacagcagtctatctgtccatagtagttatgacagtgggctctaatttcagactgcctgggttccgatgctagttctatcacttactacctctgtaatattgggcaagttacttagcatctctgtgcttattttattcattgtaaaatgggtataataatgatcccaaccttatagcattgctgggaagattaaataacagaatccatttaaagtgccttacttccggtctgttgttgcataaatgctagatatttctctcataatcaatgtcaccatgccctaggcagaatacacggcatggttctagcttctagacccccatggtactttacatataccactattatcacatcaatcatattgcatcactattgctgattgacatgtaccttcccaactgtactatgaatttattgagggcaaagattgcttcttactcacctataaacttcatagtttaacaaagaactttgtacagataagcaaaccaaagtttagaaataggttttgtcctttttcaactctaattgattgacaatgcttgcgtgaaatgccattttgaaagggatgtgaggctgaagctggtctcaacaggggaaagagcatcatgattaattagggatgtcttccatgggacaaatagagggagcagtggcacaagtgtcatggacattccattccagttttagatgctgtgtaagtaaatacttattgaatgaattttcatgaacaaatgttactagttgaaagacatgagccaattagagttattgttaaataacttggctaatttctcttacagtctaagttctttcagagcagtcattatggattttgtgctagaaacttgtgacatctagaagcatagtatgctcacagcagacaattcattaaatgtgatcaaattctgctgaaattttcatttcataggttttgccacattaatattacacctgccatctgtgatctttgccatgtaaatacagatcctgagattaagagttctttcaaggattttgaaggaactgatatctaaactgtctacatataagcaaacaatcatttaaactactgctaaatgcctgatataagaatagagaaatgcacttctcaaattttgagggcaaagactgcacaggtggcagtgctgcttaagcatttttccctgtgggatgaagtggcttatcatactggggcaaaaagagagaaaatcatagtcactagggtacatttatttcaagattaacttcatttacctagaacagtacctggtacatagtttacattaaataaatgctgatgcataagtgtataaatgaacaaatggacggatggatagatggatggatggatggatggatggttggatggatggatgaatggatgacagataaactttgcttccatgtaatcttggcaaaaaaaaaaaaattggcagtttgggctgggcatggtggctcacacctgtaatcccagcaatttgggagcctgagtcgggcagatcacttgaggtcaggagtttgagaccagtctagccaacatggcgaaacttcgtccctattaaaaatacaaaaattagcaaggtgtggtggcacacgcctgtaatctcagctactcaggagactgaagcaggagaatcgcttgaacctggaaggcggagtttgcagtgagccaagatcatgccaatgcactccagcctgggcgacaaaactccaactcaaaaaaaaaaaaaaaaaaaaaatggcagtttaaatttttttccaccagatggcaataatgtgagatataggtttaggttgtaatcctgaagagaaaaacaaccaaccaaccaaacaaaaatgctattcggagaaaaagaagcgttaaaagaacagatttagatgacagaaatgaaatgtttgtgtcatctgtaataccttaggagtctatgaccttgtgagacttgtatcaggtcctcaacatacctcctttttatgcatggatgacttctcattcataattactttgcagtaaaatggagatattcaaaaactaatcttatctatataaaattattggccaattcacacaactaaaattattacccttggtatatatatctccatgcatttatattttcatttttaatactaatttcttagttaattgatgcctcccttggatgtgaggctgcttgggaaaaatagctagcctgtgtgcctctaggaaatcttcccctgctattcaacctgccaaaagtcatatgaaataagcctgcctagggctcattcatcctgttagcaaagaattgtgaataatattatattagtgtccatcccttaattcaaaagcttttggaaaataagaaattcagttttagagtccagcattccacatatacatggagtagggcactgctgttttggaaaataaagataatatgaacatatcttcagctggtatagagtattttctcttattaatacttctcaaaacaagtcttcaattggataaaacattaacttccctaaaaagtggaaataagcagactcaggaatatttcatggtaaattatagagcatatcatctgcccttttctaatgataatcagaatgaaaaggcgtttaacctccttataaacgcttggtcactggaggctggcaaggttgttgaagaaaatgaagggaaactaacattttttgaattcctgaagatcatcactctcatgatggcattcaatacttatcacaacctcctgacataggtatggaagacagtgtggtatagtgaagaatgggggctttagagccatcgacttgatttctgatcctaactctcacctctcctttagctgtgcaacctctggcaagttatgtctctccaagcctcagttatctcatctgtaaactggggataatagcgcatacctcatcaggtgtttatgaggagcaaatgtaaagcaccttgcagagtgctagaatagaataggtacaattccaaatttatcattattattgtgatgatggtgatgatgatgaagtcaattttgcagaagaaaaagcagattcagagctgaagtatcttgcttaagtttacataactagtaaacttaaaaggcatctagtaccgtacctggtaccatagcaggtgcccaatcaacattttgtttgcattcatccttcctgatctaaaactcaattattttttgagatcttcttcctttaaaataatgagttaggctcaactttaccttggttgatgcaagattcaactactgacatacatttgcaaaaattaaaaacatttttttctgactcacaggtggtaatacatggactaagacaataaagaggattccagatcttacaaaaaaagatgataattaggcccactatttcgcctaacataagataagtcatttctccttcaaaggggtacatattttccctcctaggtgtctctactgattggcagtcagtggcagatgagatactgtttccagacttttagttcccgggtctgtatactttattttatataagtcagtgcactgaaggatggtgctggctaaaaatataaattggttcaaaatgtgtttatgtcagttcatggatgatagattcaggtttttgtccttggcctttttctagtctcaaccttctatacactctccctgggtaatctcatccatcccctggcatctctattctgagacactgatgagctcaaatctacttataacaacagcccagatctgttctgaatcctagacacacttttccaatcgctgatgggaaaagctacctggatgtcataccagcatcttaaacttaacatgtctaaaaagaaactcattttcccttccaaacctgctcctcctgctgtgttccttctcttggtaaattaatcactattctctcagtttcccaaacttaaaactttaaagtcatccttgactctgttatttccttcaacctcaaccagtaatcaattatgaggttctatcaattcgaacacacttatatctcttgagtgtgtctcttcatctccacagacattgtttggacctctaatgcgattcttagctctagcctaattcagtggcctcacagatttttctccctgcatcccattatttccagttgcaatcaatcttctacactgctgcctacacttctacaattcccctgtatacacttcttatcctaaaaattacaattgatcatgaaattctccactaattgaaagctttcttttctgatgcttaaagggaattttaaaaaactcctaaattgggcatgcgcgacttcacaatctggctccaacattccttgctctagccatattgaatgtttcaccattacaggccttcttcagagctgtatactttgcacttgcttatctgctctctaggaatgtccttctggtaaacttttattcaaattttaacttagatcaaatatcacctttctatgtactctgattcctctaaagaagttaattgtttcattctgtgtacttccacagcaccttttttatctgtaaaaccacttcatacatttaattgcaataatgtgttttgagtgtctattttctccactgcactataagtttcctgcaagcagtcatctccatcctcagcattggcttcaaggtctgacacatattaatttgtaaataaaagcttattgaataaaaagaatccgttgaaaggacgttagaatgacatcatagagacaaacttccctcaccccaaattccttttgatgaaactgcacagacaaaatctgaggctggccagctctttatactgactcagcataaaattgcttatgtttttagaactgtcaccagaatgcattcttatttctactcacaatatattaggtcaaccactctacaccctaaacccacaacccataaatcacaattgtaaattcatcttctgtaaagacaaacttacagataagtattttaatgagaactaggcatttcctaaagccaaaaacatttccataggaaataatttcccaattgtcaggcagaagaagagaattattttagaacgaacttacatgatattaactgaaaaaaatgggaaatattaaaatgaattccttgaaaagaaagatataaaacttttaccaattacgttaagggatgaaaatgagtaatatagttaacatcacaaatatttaatgtatatttgttagaatgaatatcttaaattttggctcaatttaaggttgtttttaaaatgtaagattccagtactaattagagtactgtaattttcatttgtaataattgcatttgacatggcaatatttaaagaatagttttcaatgcatgataagcacttatatttcagttgatagcaactaattccttaaatgaaacaattataaagcatatattatatgcaaaattttatggaaaatagagatctgtcatgatccccatctttattgagtatacagtctaggagaatatatataaccataagaagaggttaaaaagaggccgggcatggtggcttatgcctgcaatcccagcactttgggaggccgaggcgggcagatcacatgaggccaggagttcgagaccagcctggccaatatggtgaaaccccatctctactaaaaatacaaaaacattagccaggcatggaggcgcgtacctgaaatcccagctactcgggaggctaaggcacgagaatcacttgagcctacgaggcagaggttgcagtgagccaagatcatgccactgcattccagcctgggcaacagagtaagactctgtcagaaaaaaaaaagtaaaaagaatgtattttcaaagttcacagaggaagatcacctacacagtgaaacagtgatgatgttgggggtgatggtgaggcaaggattcagtgggaaaggatgcttgtaagctaggccttgaaagatggttgaatatgcataaagagagatagcagcaaattgtatcccaagaaagatgtaacagcacagcaaagggattgaaaagagatgaggtgagatcccggtagaccagtaaagaaacaaaaaacagtctaggtgagatataatgagagtaatgatcatgaaaatggaaaggagaaaatggatttgagagatgtagagattaactctgctggatgaggaaactgattagatatagtaagtatgtgtggttgggagaatgggagcatcattaacagatgtaggtgatacaaggaagatgagtgggattaggagtgttaagatgattgcttccactttaaatagactggtttagaggtgtcagtgtattattcatttggaaatgccggggaggttaactgaaaatttaggactagagtttaggaaggaggttaggtctgaagataaatatttgaaggtcactcaaatagatgtgatcattgaagccatctgagtaaaaatatttcggggttcaagcagtaatcttcaatcttgagcaggaatcagaatcccctggggatttgttaaaccacaaatgggtcccacccccagggtttctgactcaatatgtctagagtggggctggagaatttacactctaaaaaaattctcaggttttgctgttgttgctagtcaagtccacacttggaggacatagaaaattaagtctattactttttatctcagcattaacttattcataaaaaagataacttgtgccatccgggcgcggtggctcatgcctataatcccagcattttcggaggctgaggcgggtggatcacgaggtcaggagtttgagaccagcctgaccaacatggtgaaaccccatctccactaaaaatacaaaacgtagctgagtgtggtgaggcgcacctgtaatcccagctactcaggtggctgaggcaggacaatcgcttgaacctgggaggtggaggttgcagtaagccgagattgcgccactgcactccagactgggcaacagagtgagattctgtctcaaaacaagacaaaacaaaacaaaacaaaacaaaacaaaaaaacaaaaaaccttgtgccaatgtcagtatcttctacgtcattaaaatagtgtctaacacagtttatctatcaattggaacaggaaatcgtatttctactagttttttgttagaaactgtcttgtcaatccataattgagaaactaagactgcccaaagaatatgctccaaaatatggctattgtaggaagggttctaaaaaattcttactttcctttcagactcggctacacaatgtttctacattacggtgatagactttctggaaccctgtttggtggtctccactaacctgctagctttgtcagcagccaaatatttatttgagacttctgtcccatataagcaatggcttgaaaagcacttagctgtttacttttcatcttactataaattatttatccttcagtctataaatggctatttgtaggattacacaaattttgaatgctctgataagaggactgcagcatccaaattcatgcataatccataaaaagcacatgtaacctacaacctcagctgggctgacatatgcaatagattctctgagcatatataagcagtgcgaattattaaccagttaacattagcaaatttatttttgaaacaaagtttatgcacacaagcattctctaatgagaaataatatttgttataaagatccaataaaaacataccttgagtagatttttctacttctttcctctttctactctggctattgtaattcatcctcagctcctggttatactcgtgcagggtctccctggagttgtatgactgtcttggttttcttccatcttcactctcatcagaagaactggtgtaagctagatccatttcatgcttgacttttggtagaggctggtagggtttgcagtcagtttgctccatctctgattaagcaagctcagtttcatgaaaaaaaggatgaggaagtcctttaatgcaagcagtc

SEQ ID NO: 1372 - DNA, 587912 bp, Homo sapiens; identical to SEQ ID NO: 1371

SEQ ID NO: 1373 - DNA, 587912 bp, Homo sapiens; identical to SEQ ID NO: 1371

SEQ ID NO: 1374 - DNA, 50736 bp, Homo sapiens
cgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatctgatttagatttttttactggctaggactctgactgaggtgctggtgtgaggcctagaattactgcagctattttgataccattagaatgcacagtcaaggataaagctttcatgtaaggaagggtatagcagagaaaattatagaaaaatgaagcagaatcttaatcaaattgtacttaaagtcagataacttctggatgcaactcactgaagtaagaataggtggatatttcttaaatatgacaaaaatatatacatttctaacaagaagcctttcatgtttaagggataaacactagaagcatttccattaaaattaggaaaaagacaagaatgccagttatttccacaattatttaacattgttctagaagtactagttaatgcagtcaaccaagagaaagaaatgtaatattgatattggaaaggaaggggcaggcaagattatcattaccacaaatgaagcaaatctaagagaatcaactaaagactacttgaaacctttggaactccataaaaaggctggttatgaaatcaatagaataaaaactgatcactttcatatataaaaacaacaaacaaaatgtaaaataagaaaaaaaatctaaattacaatagccatgggaaaagataagctccttttgaataaacttaacaaaaaaatctgtaagacatatccattcattcagtaaatatggattgataacctacagtgtgccaggcaatgttctaggagttatttttatttaaaaaatttagaaactgctgagaaaaataaagacaaataagtagaaaaactgggttgttggatagaaagatattcctgtaaagatgccaattatcactcagttaacttataaattatgtgcaacacaaattgaaattaaaaacggtagtttttaggggactataacaaaataacagattttagtctctaaataaatacatgtgaacaggcaggtaatgataaaaaagatgagttatgagagaccttacccttcagatattgaaacatattatgaagatactatagttaaaacagtttgttatttaagaagaaagaaaagataacagattaaaagaatataataaagaataaagaaatagatacaaacatatgtggatgtttagattatgataattatggtaaagatggcactttattttttattttttgggtattatacatttaatttaaagacttcgaagtaaaaaaaaaaggtacagaaatacagattacattgtgatgaccccagtagtattctacatgacaaaaataaaaacagatttaagtaaatgtatcggcactgaacaagcatttacttaacatccaatccaggctgcatatgcacaaaatgatctgaccacatgcttatgcaaagtagtttttcttagaacgccaaaattccaaccattctgactgtccgctgcgcattcccctgttgagtattttgagcgaacttctatagaatataaaaacaattggcatggcacttaaagactgcaaaaaacagaacacaattaaaaacatttataatgcatttctgtataaaatatacaccataaagaccaccctgaataatggttaaaacctcatcatagaaaaatgctcatcattttgcacattattgatagaaactactgagaggttttcttggggggctggtgggaaggtagacacccaacttaaagattcattcaaaatttgctttaaattgtgggtaataactcactgcttacccctctcaaaatgttttatcatgaatactctaatatttaaccacaggacaaacataaagaataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccataacatatttctgacatgagatacagaattctaagtttatgatttgaagtgaatactgctttttgttttaaaacaagtttcagatgttaagagaaacatattaaataaacatgtgcatgtatataaacattttcctttgaggttttcattgctttcagacttatgttatttgaaggaaagagagtacacagctagaaactttggaaaaatgacatttccaatgaaatgtagcatccacccctccaaaaaaagataatttattaaatgcctacaaattttgaaacatttgaaatttaaactaggacactttcctaaaattaagttttactaagattaaaaaactttaagtaatttagatgatcatggttactttttaagtcccttttcattaaaaaatatttaaaataaacaacagaaggatgctatatttggcacccccttaaataaactgctaaacactaatattaataaaaaataatccaaggaactctgcctctgaaatgtattctactatgtgttacatgtgttatccagttaataaaaactcactgaaagagctga

SEQ ID NO: 1375 - DNA, 50736 bp, Homo sapiens; identical to SEQ ID NO: 1374

SEQ ID NO: 1376 - DNA, 50736 bp, Homo sapiens; identical to SEQ ID NO: 1374

SEQ ID NO: 1377 - DNA, 117726 bp, Homo sapiens
cagggaaagggacagggaagaggctgtcgggaaatggcggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtcccattaggaggagggggagggcggcaggtgggaccgggcacaggcctagtcgtgcgacaggagaagggaaggaagggccggccccagctgggtcctccttgcgtctggcctgtgccggacgcccccgactccgagtgatctcgggccggtccccgggggagtccagcttctcgcgccaggggagttctcagccccagggcagtccagggattaggcggaagggggcacgcagccacctggccggggcagggggagctgcgaggagccttttttttttttttttttcctgcgcagagccccttgcgtgacacacagtaggcgctcaatacatgtttattttcagttgagtgttgcttcagcttttatggcttgtgataaatccttatccttctgttctagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattagtgcttggtggttctcaaattatttcacgcgtggtagttttgatttttgcttttccagtgaggctgtacctttcatccttaggcaaatatgatggctttcaaaagcagctatggggtgggaactgggagtggctgcaaatgggcatggagcgtcttttagagataacgaaaatgtcccaacttagattgtggtgatagttcgcacaactctataaattactaaaaactattgaatttgcacttgaaaagggggagaactttatgaaatataaattataactcaaagaagctcttaaaatgcctatggaataataagtaaagagtagtggggatatgatctattttgtggggagactagcagcaaagtaagacataaagataaagaaacatacactggcctgaggaagtaacaaagtctctttgagcaaactttggacaggctcctctcagctttcttttcaactacaccttgtccttgggccctgtcctcggcctgcctagcccagttttagcaagagtcctgctgagtaactccctcacccttgatacctgatcaccttgtcctgccttgagcgagaatcctgtttagtcagttgagcaagaatccccctacccttgatatctctctccccttaggaattttctttctactgactccctcactctgctgcttgactgtaaatccacacttgtcctagttgtctttggattgagcttagttctatactgaagtctcttttcctctattataatagtactcaaaatatggctttactgcttttgactagtatctggctctgtttcccattggcggaaggcactctcagacagtgcttctagtagtatatattagcatgacctgccagggtacaattctttttaaaaagaccaccaattggctggatgcagtggctcacgcctgtaatcccagcactctgggaggccgaggcgggtggatcaggtcaggagttcgagacgagcctggccaacatggtgaaacccccatctctactagaaatacaaaaattagctgggcatggtggtgtgcgcctgtaatcccagctacttgggaggctgaggcaggagaatcacttgaatgcaggaggcggaggttgcaatgagccaagattgtgccactgcactccagcttgggtgacagagtgggcctccgtctcaaaaaaaaacaaaaacaaaaaaaagaccaccaatttattgccaggcattgtactgggtgctgaggaaatttgaggaaaaacacctattaagttcctgtcctcaaggagctcatagtacagtggggagccaagtagcaagcaaatagccatgcaagtgtataattgcaatgaggacaagtatcatgaaaaggagggtacatggtgcaatgagagcctataaaataggggtattcgactagtcaaggtggtcaggaattgcttcaaagaagcagttattgagctgagagttaaaggaagaatagtggctaattagattggaggtgagagttggaggagctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctcaaaaaaaaaaaaaaaaaaaaagaaaggaaaagaaaatattgccctggctacagtgtggataaaggattgggaaggagtcagaatgtatggagagttttattagaagccatttcaacaatctagagtagaggtaatagtagcttgtactacaatagccatggtttacatggaggggattggtatattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaaggttaaggtgtgggcaggtttggtgtctggtgaggccattctctttttccaagatggtccctgcacacactgtgtcctccagaggggaggaaggctagatcatgacatggcagaagacagaaagaagggccaagagatagagcaagaggagaccgatcttgcccttttataatggcattaatcccacctgtgagggtagagccctcatggcttaatcacctcttaaaagtctcacctcttaatactattactgcaaccgcccagtgggttcaccttgcctgctgcctagacagagatttatcaagacaggagagttgaaatgaagaaagagtaattcacacacagccggctgtgcaggagaccagagttttgttattacttaaatcagtctcccagagcatttgggggatcagttattattattattattattattattattattattattatttgagacagagtcttgctctgttgcccaggctggagtgcaatgatgtgatttcggctcactgcaacctctgcctcccgggttcaagcgattctcctgcctcagcctcccgagtagctgggattacaggtgcccgccactatgccaggccaatttttgtattttttagtagagatggggtttcaccatgttggccaggctggtctcgaactcctgacttcaggtgatccacccgcctcagcctcccaaagtgctgggattacaggcgtgagccaccgtgcctggctgggatcagagtttttaaagataacttggtgggtaggggcttgggaagtacggagtgctgatcagtcaggttggagatggaatcatagggggtcgaagtgagtctttcttgcagttttgtgttctgggtgggatggcagaactggttgagccagattacaggtctgggtggtgtcagctgctccatcgagttcagggtctgaaaagtatctcaggcactgatcttaggtttcacaatagtgatgttatccccaggagcaatttggggaggttcagactcttggagccagaggctgcatgacccctaaactgtaatttctaatcttgtagctaatttgttagtcctgcacaggcagactagtccccaggaaagaaacgcctatgatcaattttgtttcagaatcaaaccacaaactgaattccttcccaaagttagtttgacctatgcccaggaatgaacaaggacagcttaaaggttagaagcaaggtggagtcggttaggtctgatttctttcactgtcataatttcctcagttataattttgcaaaggtgatttcattacaatggcaattaaatttttcatttttattttatttatatatatatatttttgagacggagtctcactatgttgcccagattggagtgcagtggcgcaatcttggctcagtgcaacctctacctcctgggctcaagcgattctcctgcctcagcctcccgagtagctgggattacaggcgcccaccaccatgcccagctaatctttgtatttttactagagacaatgtttcaccatgttggccaggctggtcttgaactcctgacctcaggcgatccactggcctcggccccccaaagtgctgggattacaggcgtgagccaccatgcccatggggcaattaaattttaacatgagttttggagaagacaaacattcaaaccatggtagtcttcatcctcattttcgcgaattacagcttttaaaacccttagaatctctgaggtgatgagagtatcttttgccctgggtggtggctcacgcttgtaatcccagcactttgggaggccgaggtgggcggatcaccaggggtcaggagtttgagaccagcctgaccaacatcgtgaaaccccatctctactaagaatacacaattagccgggcatggtgacacatgcctgtaatcccagctacttgggacgctgaggcaggagaatcgcttgaacctgggaggcggaggttgcagtgagctgagatcacgccattgcactctagcctgggcaacaagagtgaaactccgtctcaaaaaaataaaaataaaaataaaaataaaaaagtatcttttgcatgctaatgagataactggtggctgaggctcctaggtagatttaggacgggggcgctggtcaaggcaggattagagagttgagactttttcaccacacccccagcctctggggaagggagaggagctgaaggttaaattgactagcagtggccaatgatgtaatcaatcatgcctacatagtaaagcctctattttatttattttttatttttatattttgagatggagtctcactcttgttgcccaggctggagtataatggcgtgatcttgcctcactgcaacctccatctcacgggttcaagcgattctcctgcctcagcctcccaagtagctgggattacaggcatgcaccaccacgcctggcaaattttgtatttttagtagagacagggttttgccatgttggtggggctggtctcgaactcctgaccttatgtgatccacccacctcggcctcccaaagtgctgggattacaggcgtgagccaccgtgcctggctgtaaagtctataaaaacccgaaagaattgggtttggagagcttctggatagcgaacacatggaggtacctagagggtgctgtgcttgtagggggcatggaagcttggtgccccttatcctgtaccttgtcctatgtgattgttccatctggctgtccatctatatgctttgtaatatcctttataataaacctgtaaacatgtttttcagagttctgtgaccctctctagcaaattaatcaaacccaaggggagggtcatgggaaccctgatttacagtgggtcagtcagaagcatagcttacaacctggcatctgaagtggagagcagtcttgtgagcctgagctctcaaactgtgggatctgacactatctccaggtaggtagtaacagaactgaattcaattagaggacatccagctggtgtccactgcaaaactgattgcttgatgtatgggaaaattctcccatacatctggggctacagaagcattctatattaaatagagagtataggaaaatccacattttgtttactcccccctgtatcttacagtgagagtgagcggtcaagggtgacttctcagtttctggcttgtacaactggatgtttggagtaacagcattaagaagcaggacctttaagatcacattgaatactaagttcaggtatgaggactgtgagtttagtcttagacatactgtgtttgacgtgcctttgagaacacccaagagaatataggtagttggatggatggatctagagctcagaaggggcctatatattggatatataaattgtgtgctatatggatatagttgataattcaagccatgtgtggggataaggttgtctaggccaaagagtatcagagtgagaatgcaggagatcaaagaaggaggcttgagaaactccagtatttcatgtggagtacaggagagtcagcctgcaaaggagactgggaaacagcagccagggaggtttaaaagaaagttaggagggacttgtgtcattgaagccaaagaaagaaactgtttcaagatgtagggaatggactgttaacaatgtccattgctgctcagaggtcaaataagatgtggactggtaaatatgtgttgcatttaagaatatggaggcattggtgtcctggatggatctattttcatggaatgacggggcagaaatctagaatggaacagattggagtgtggttagcagagagaggaaggcactttttttttttttttttgagacggagtttcactcttgttgcccaagctggagtgcaatggtgcgatctcggctcactgcaacttccgcctcccgggttcaagcaattttcctgcctcagcctcccgagtagctgggattacaggcgcacaccaccatgcccgactaattttttgtatttttagtagaaacggggtttcaccatgttagccaggctggtcttgaactccttacctcaggtgatccgcctacctcagcctcccaaagtgctgggattacaggtgtgaggtactgcgcccagccggtaggcaagtaatggaaacaaagaatataggcagctatttgaagcactttggctgtgaagggcatggaaaagtcagggtagaagcaggagcgagactacgggtcaagagaggcctttcaaattatttatttatttatttttttgagacagggtctcacgctgttgcccaggctggagtgcagtggcacaatcacagctcactgcagccttgatttcttgggctcaggcgattctcccacttcagtcttctgagtagctgggattagaggtgcgcacaccaccacgctgggctaatttttgcattttttgtagacatggggtcttgccatgttacccagtctggtctcgaattccagggctcaagcaatctgcctgccttagcctcccaaagtgctgggattacagtcttgagctgctgcacccagccaaggactttttttaatggagaaattttgtggatgtgtaaagtttacaattaagggtctgtagggagtgagtggttaaaaatacagcagagagatgggataaatcatagagtacgtttgctaagagagaggagcatctggaatcgaaagcataggtggaggaattagtgttcactaaaaggcaagagcatctctgtcttaattgaggaactaactgctggtaggatgtgtgcaggtatagttggtttatgtttggtgttaggaagatgagagacaacttccttctaaaggctcccccaaccccgttattttttctgtaaatgagggtgtggtcatctgcatgtagagataataaggaggaggagttggaaggctgaagagaatggagaaggttcaatgagttgtaagggtgagagcaggttgtaggttgaccagagaaaaatagaaggactgctgagaaatgttgatggctcacttctggttgttgatggtaaatttactatgagccaagctttatttttttctaagtgcttctctaagtgttctagtgttttatttaatccccaaagcagctctatgaggtaggtattattattatcacccccttgtcacagatggtaaaatggaggtacagcaaagttgtgtcatttgtttaaggacaaagagctagctaggtttggagccaggtagtctgactccaaagcccatgatcttaaccatcactctaaaatatatcctaaaaataggtcctgatcatactttttcattgataaacatagatctgtataatcacatttaaggactacattgttggttttatgcttgatggtctgtccagtgacttttccagaaactctctagctgcattcttgagtcaatgccaaatctcagaaaggagagagcttatttgaaccctatgttacaagagttttgatttcctttccttctagtttgttgtattttccaattttctatagagagtacatataattttcattttgtggggaaaaataaagttaacatctctaaaataaaaaagccaggctaggaagggaatagaggtctaagactcagtgtttttaaaatctactatagctaaacatgtttactttgtgtcttagtttattttgtgttactataacagaatatctgagactgtgtaatttataaagaaaagaggtttatttagaggtttatttagttttgcaggctgggaagttcaagggcatggcctcagcttctggtgagagctttctctctctcattttttttttcaagacagagtcttgctctgtcgcccaggctggagtgcaatggtgcaatcttggctcactgcaacctccacctcccaggttcaagcaattctcctgcctcagcctcccacgtagctgggactacaggtgcacgccactgtgtctggctaattttttttgtagttttagtagagatggggttacaccatgttggccaggctggtctcgaactcctgatcacaggtgatccgcctgccttggcctcctaaagtgctgggattacaggcatgagccactgtgcctggccgagagctttcttgacacatcataacatggcagagaaggtcaaaggggaagtgaacacatgtgaagaggcaaaaccttaggggcatcctggctttataaaatcctactcttgtgggaactaattcattcctaagggaatgaatccagttttgaaagagggagaactcactcactaccatgagaatggcaccaagccaatcatgaggtatctgctctcatgacccaaacaccttccattaggccccacctcccaacatgccacattagggatcaaatttcaacatgagttttggtgaggacaaactatatccaaagtatagcattctataattcaacaactccattcctagaaatttcatttcaagagaaattaaagcttatgtgtatataaagacgtgtacaccggtgttcttaccaattttatttataattgccccaaactggaaacagacaaatgtgcataaacaagtgagtagataaactgtggtatatccatacaagggaatactatttagcaataaaaaggaataaatccttcatatatacaccaacatggacaaatctcaaaataattatgctgggtgaaagatgtcagattaaaaaagagagtatatactgtattattacatttatatagtataggaaatgcaaattaatatacattttcagtactcagatcagtggttacctctgaaggtgaggattaactaggaaggggcatgaaggaatcttatgaggtgatggaggtgttttatatcttggtctagttacaccagtgtatacatatcaatttcattaagctgtgcatttgagatttatgcatgttactctgtgaatgttgtatctcagtaaaaaggttaagacaaagtttagctccttttgtcagtctcctttccctttcctttgaccctttcctatatttctttttctctccatctctctctgttctctactttttgtatccatttgagagagagttgatggcacatcaggcactcatgctgactctacacttaaccctgccaattaaatgttcacatcccttcaaatgtacagtttattcaggaaagtaggattgaagaagtctgtggttaaagaatagctcttaggagtgaacatttcttccttttcccttgcacttgaattagatacgtatctttgggccttcacttctgttttggtatttcttttcctttttttttttttttttttttgagacagagcctttgtcacccaggcgggagtgcagtggtgtgatcacagctcactgcagcctcaacctttcgggctcaggcaatcctcctgtctcagcctcccgagtggcatgtgccaccatgcccggctaattttttaagttatttgtagagatggggtctccctatgttgcccagactggtctcgaactcctgggctcaaggaatcctcctgcctcagcctcccaaattgctggaatcacaggcatgagccgctgtgcccagctctgttgtggtatttctttaacagctggcgttataggaatcagacagacttgcctttgaatccctgctgcaccacttgttagctatttgatcctgatacaatgacttatcttctatgatcctcagttttctcatccagagcatgggtataataatgcctacctcctagattgtcttttttttttttttttttttgaggtggagtttcgctcttgtcgtccaggctggagtgcaatgacgtgatcttggctcactgcaaccttagtctcctgggttcaagtgattctccaacctcagcctcccgagtagctgggactacaggcatgcgccaccatgcctggctaatttttgtatttttagtagagatggggtttcaccatgttggccaggctggtctcaaactcctgacctcaggtgatctgcccacctcggcctcccaaagtgttgggattacaggtgtgagccaccgcgcccagccaggtgtcttaagaattaaatgagataatattggtaaagcactttgcctgccatcgagaggccacttaatttcggatggctttcttatttcccaagactgtgaacttgtgacttttgactcttggatgacatctagccctgctccattagacattaaataactctttttattgttactagtataacaactagggagaggacttatacttgcaatatgacttttaaatctgtccttgggctcacataacatgtttcttaccatataagaatggagaaggcttttttattggcttccacgacattcctgggtggttggtttgagacagctagttgttgctatcctgttacagaggtgaaggcaggagaggcatcttgacttcaccaagatcttatatcttgtatggtgataggtctggcactgacaaatgttctatatctttccttgagcagatgtaataagacattacagacatctgagtaaataaaaatagggttatggtttttcttcctaccccagactctaccagatgactcattcctactacatagaaataacagtgaatgtcaaccataacacagatgcctatttatttctctccttactgactcatttttgagagctttttagctagttgtgctatttagttgatctcaaagttatcttctgcagggaagtttcggtggaaagaacactgatatttgttgaatgattgctctgtgtcaaacatagggctagttgtttttaaggaggtctaatcaactctgaggtaataaacactattggattttggagaatgagaaaacttgattgtggaaaacagaaccagtttctagaccgccactcagctaatatgtgacagaagaaatatcccttatccccatccattgattttatttctttttgcttcagatttaaagagcatgtgacaaatagtctagcctttctctgtcttagccccattgcagtcactgttaaccaactatcttcttgaaaccaaaatgactcagcctaaccacagaagcaaatcaaacactgatggcccataatctccagacaaggctttaaccaaacctctgtctatccatctatccatttgttcattcattcaacagatatttgttgagcattgactctttgctagacattgtgtgaggggttgttgttgatgctagagtagaactatttatcttccacaaatgaggcatgaccctgctagggacctgtgttactagcaagcagctttgaggtcagggtaggaagtgaggatagagtctcagaaggaagaaaataaatatttacagagtgtggattgtatccaattcatgggatcctgggaagttcattaactgccaggaggattcctagttctcagctctaggcagcagcatcttggaaggcttctctgaaggtggactccgaaggatctaaggctcagatgttcccctttcagcttctgccctccattccctgcactcctaggtcttagatggtcatgcttgtctctgtatccaaaacctacttttggcacatttttatttcctcccaagctgtaagaacagcttgttcacttgggaaggtcatacttcaaagtggaactctgccatttcagaggggctttgaagatacacagtatacctgggggagtgaaggagttgggtgtcactccccaggataaggcaaacaaaaacaagaacagacacatatcactatgacttaggtatggattaaagattaactgcaccttgcacagaggtggctctcaatacgttttctgcattccatcttgagcatcattttttggctctattgtattctacacttccttcccagaagtttacagtgtttcctaattcactgataagcagttaaaaaattgccccacatttggtattacaaaagtttatgcaccacgtttcttttttttttgagacagagtctcgctctgttgcccaggctggagtgcagtggcacaatctcggctccctgcaagctctgccttccgggttcatgccattctcctgcctcagcctcccgagtagctgggactacaggcacccgccaccatgcccggctaattttttgtatttttaatagagatggggtttcattgtgttagccaggatggtcttgatctcctgaccttgtgatctgcccgcctcagcctcccaaagtgctgggattataggcgtgagccaccacgcctggcctgcaccatgtttcttaaaggcatatatagtgattgttttcttttctagttttgctaatagtgtatgttttgctgatcatgtagtaacagtgttttctttataaatttatgaaagtacaaaaagatatatatgaaaacaaatgagccagaggaaattactattgatattctggcatattttcctccagcttttcaacaaatcttgaatatataatcttgaattactcttttaaaaattgacattataacatacgcattttcctgttttcatttaaaaattcccataaacatctgtttcaaggtttgcatattctcccttttatggctgtaggcaggttcactgaatgacaacttagccttgaagccctctatgaccactcttgaccctatatgtcttgcctctggaatggactgaagcgaagatgagtcccgtgttctctatcccttaatagtggtttcatgtgagggagttctgctttgctggatagggtgaatcacatcctccaagacaccagccttctaaaacatttaccatatagggctgggcgcggtggctcatgcctgtaatcccagcactttgggaggctgaggcagtaggatcacgaagtcaggagttcaagtctagtctgaccaatatggtgaaaccccgtctctactggaaatacagaaattagccaggtgtggtagtgctcgcctgtagtcctagctactcgggaggctgaggcaggagaatcgcttgaacctgggaggcagaggttgcagtgagccgagatcctgcccctgcactccagcctggcaacagagcgagattctgtctcaaaaaaaaccccatgtatatacatatatacgtatatatacacatatatatgtatacatatatgtatatacacatatatacgtatatatatgtgtatatacacgtatatatgtatacatatatgtatatacacatatacacatgtatgtatacatatatatgtatatacgtgtatatatgtatacatatgtgtatatatacacgtatatatacacatatgtatacgtgtgtatatatacgtgtatatacacacacgtatacatacgtatatatatacgtgtatatatacacacatgtatacatatgtgtatatgtgtatatatacacacatgtatacatatatgtgtatatatacacatatgtatacatacacgtgtatatacacacatatgtatacatacacgtgtatatatacacatatgtatacatatatgtgtatacatacgcacgtatacacatgtatgtatacatatttgtatatatactcacatatacacatatgtatacatacatgtgtatatacacgcacacatacacatatatgtgcatatacgcacatatatacatatatgtacacatatgtatatatacacacatatatacatatatgtacacatgtacgtacacatatacatatatgtacctatatgtacatatatacttacatataaacatatgtacatatatgtacatatatacttacatataaacatatgtacatatatgtacatatatacatacatataaacatatatacctgtatgtgtatatgtatacacacacacacacgtacttaggacagtgttgtgcaataggaaggtcttcataaaaacatttttgggaaaagtacttaatttctctgagtctgagtttcctcatctgtcacatctgtttcctcatctgatccatgtggattgcaggtacaacaagtcactgggttgttgtggtgattaaatgagaaaatgtctataaatgaatcccagtgcttggcacatagaatgtgctccataaatgtcagtcattattactattccctgataaatgacgtagtgtggagaagtatcgattgagtacagaaaacaggacagggcttggaagtggtgattaatgatgatgcaaaaaaaaattattctcctgcaaaacctgcttgctttatgcacatttggactattggggcagagaccatggtgggcctgtgggctttgaaaccacctcagaaaacattttgccttagaacattcttttctatttttatttttaaaaagaagatatcttgggtggttatccacttttttttttttttccgagatggggtctggctctgtcgcccaggctggagtgcaatggcttgatcttggctcactgcaacctctgtcctctgggctcaagcaatcctcccacctcagcctcccaagtagctgggaccacaggcacatgccaccatgcctgcctgttttttgtatttttagtagagacgtgggtctcaccatgttgcccaggctgatcttgaactgctgagctcaagcgatctgcccaccttggcctctcaaattgctgggattacaggtgtgagcaatgtgcctggttagagtattctttttttttttttttttgatatggatcctcatactgtcgcctaggctggagggcagtggcatgatctctgctcattgcaacctccgccgcccaagcgattctcctgcctcagcctcccgagtagctgggattaggggcatgtgccactatgcctggctaattttttgtatttttagtagagacagggtttccccatttggccaggctggtctcgaactcctgacctcgtgatccgcctgcctcagcctcccaaagtgctagaattataggcgtgagccactgcgcccggccatggtcagagtattcttaaaaaacatcaaaatgagtatagggtgggaagggactaacatttttttttattctattcaatttatttatttatttatttattttttattatactttaagttttagggtacatgtgcacaacgtgctggttagttacatatgtatacatgtgccatgttggtgtgctgcacccattaactcatcatttaaccttaggtatatctcctaatgctatccctcccccctcccctaaccccacaacaggccctggtgtgtgatgttccccttcctgtgtccatgtgttctcattgttcaattcccatctgtgagtgagaacatgcggcgtttggttttttgtccttgcgatagtttgctgagaatgatggtttccagcttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacagtaaacatacgtgtgcatgtgtctgtatagcagcatgttttataatcctttgggtatatacccagtaatgggattgctgggtcaaatggtatttctagttctagatccctgaggaatcgccacactgacttccacagtggttgaactagtttacattcccaccaacagtgtaaaagtattcctatttcttcacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgaggttgtttgatttttttcttgtaaacttgtttgagttcattgtagattctggatgttagccctttgtcagatgagtagattgcaaaaattttctcccattctgtaggttgcctgttcactctgatggtagttttttttttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatagttgtagatatgtggcgttatttctgagggttctgttctgttctattggtctatatctctgttttggtaccagtaccatgctgttttggttactgtagccttgtagcatcgcttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcaggatattgattcttcctacccatgagcatggaatgttcttccatttgtttgtatcctcttttatttccttgagcagtggtttgtagttctcctttacgaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctgtcagcttaaggagattttgggctgagatgatggggttttctagatatacaatcatgtcgtccgcaaacagggacaatttgacttcctcttttcctaattgaataccctttatttccttctcctgcctaattgccttggccagaacttccaacactatgttgaataggagtggtgagagagggcatccctgtcttgtgccagttttcaaagggaatgcttccagtttttgcctattcagtatgatattgactgtgggtttgccatagatagctcttattattttgagatacgtcccatcaatacctaatttattgagagtttttagcatgaagggttgttgaattttgtcaaaggccttttctgcatctattaagataatcatgtggtttttgtccttggttctgtttatatgctcgattacgtttattgatttgcgtatgttgaaccagccttgcatcccagggatgaagcccacttgatcatggtggataagctttttgatgtgctgctggattcagtttcccagtattttattgagaatttttgcatggatgttcatcagggatattggtctaaaattctctttttttgttgtgtctctgtcaggctttggtatcaagatgatgctggcctcataaaatgagttagggaggattccctctttttctactgattggaatagtttcagaaggaatggtaccagctcctccttgtacctctggcagaatttggctgtgaatccatctggtcctggaccttttttggttggtaagctattaattattgcctcaatttcagatcctgttattggtctattcagagattcaactccttcctggtttagtcttgggagggtgtatgtgtcgaggagtttatccatttcttctagattttctagtttatttgcgtagaggtgtttatagtattctatgctggtaatttgtatttctgtgggatcggtggtgatatcccctttatcattttttattgcatctatttgattcttctctctttttttctttattagtcttgctagcagtctatcaattttgttgatcttttcaaaaaatcagctcctggattcattgatttttttgaagggtttttgtgtctctatttccttcagttctgctctgatcttagttatttcttgccttctgctagcttttgaatgtgtttgctcttgcttctctagttcttttaattgtgatgttagggtgtcaattttagatatttcctgctttctcttgtgggaatttcgtgctataaatttccctctacacactgctttaaatgtgtcccagagatgctgatatgttctgtctttgttctcattggtttcaaagaacatctttatttctgccttcatttcgttatgtacccagtagtcattcaggagcaggttgtttagtttccaagtagttgagcggttttgagtgagtttcttaatcctgagttctagtttgattgcactgtggtctgagagacagaccacattataacaaacttgttataatttctgttcttttacatttcctgaggagtgctttacttccaagtatgtggtcaattttggaataggtgtggtgtggtgctgaaaagaatgtatgttctgttgatttggggtggagggttctgtagatgtctattaggtcttcttggtgcacagctgagttcaattcctgtatatccttgttaactttctgtctcgttgatctgtctaatgttgacagtggggtgttaaagtctcccattatcaggctgggtgcggtggctcacgcctgtaatcccagcactttgggaggctgaagtgggcggatcacgaggtcaggagatagagaccatcctggctaacagggtgaaacccaatctctactaaaaaataaaaataattagccaggtatggtggtgggcacctgtagtcccagctacttgggaggctgaggcaggagaatggcgtgaacccgggaggcagagcttgcagtgagccaagatcgcgccactgcactccagtctgggtgacagagcgagattctgttccccccccaaaaaaagtctcccattatattgtgtgggagtctaagtctctttataggtctctgaggacttgctttatgaatctgggtgctcctgtattgggtgcatatatatttacgatagttagctcttcttgttgaattgatacctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtatcttttaattggagcatttagcccatttacatttaaagttaatatggttatgtgtgaatttaatcctgtcattatgatgttagctggttattttgctcgttagttgatgcagtttcttcctagccttgatagtctttacaatttggcatgtttttgcagtggctggtaccggttgttcctttccatgtttagtgcttccttcaggagttcttttagggcaggcctagtggtgacagaatctctcagcatttgcttgtctgtaaagtattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgccctttctctctggctgcccttaacattttttccttcatttcaactttggtgaatctgacaattacaattatgtgtcttggagttgctcttcttgaggagtatctttgtggcgttctctgtatttcctgaatttgaatgttggcctgccttgctagattggggaaattctcctggataatatcctgcagaatgttttccaacttggttccattctccccgtcactttcaggtacaccaatcagatgtagatttggtcttttcacatagtcccatatttcttagaggctttgttcgtttctttgtattcttttttctctaaacttctcttctcgcttcatttcattcatttgaccttccatcactgataccctttcttccagttgatcgaattggctactgaggcttgtgcattcgtcatgtagttctcatgccttggttttcagctccatcaggtcctttaaggacttctctgcattggttattctagttagccattcgtctaattttttttcaaggtttttaacttctttgccatgggttcaaacttcctcctttagctcggagtagtttgatcatctgaagccttctcctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtctttgatgatggtgacgtacagatggcgttttggtgtgtatgtcctttctgtttgttagttttccttctaacagacaggaccctcagcttcaggtctgttggagtttgctggaggtccactccagaccctgtttgcctgggtatcagcagcagaggctgcagaacagcggatattggtgaacagcaaatgctgctgcctgatcgttcctctggaagttttatctcagaggagtacccggccgtgtgaggtgtcagtctgcccctgctgggggggtgcctcccagttaggctactcggggaccagggacccacttgaggaggcagtctgtcagttctcagatctccagctgcgtgctgggagaaccactactgtctttaaagctgccagggacatttaagtctgcagaggttttggctgccttttgtttggctatgtcctgcccccagaggtggaatctacagaggcaggcaggcctccttgaactttggtgggctccacctagttggagcttcctggccgctttgtttacctactcaagcctcagcaatggcaggcgcccctcccccagcctcactgccaccttgcagtttgatctcagactgatgtgctagcaattagcgaggctccgtgggtgtaggaccctccgagccaggtgcgggatataatctcctggtgtgccatttgctaagaccgttggaaaagcgtagtattatggtgggagtgacccgattttccaggtgccgtctgtcacccctttctttgactaggaaagggaattccctgaccccttgtacttcccgggtgaggcgatgccttgccctgctttggctcatgctcggtgtgctgcacccactgtcctgcacccactttctgacactcctcagtgagatgaacccggtacctcagttggaaatgcagaaatcacctgtcttctgcgtccctcacgctgggagctgtagactggagctgttcctattcggccatcttggctccaccccccgggactaacattttttgaatgcctgctatgtgcctgatgctgtaaagtgcttcctccatggtttctaatttaatgctctcaacaatattgtgaggtagagacataatcccagctttactgataatgatgctgagcctcagacaggccctgaaagtcttagaagttcacataactgctaagaggcagaatttccatgcaaatcccaggagtgcctggctccaaacccacgatcctcttacttcaccatgatggtccgcttgctgaatggctcagcaaagcagccaacttaccatctccttcaccttgaaaaagccctgattccatgaaaggcaaagaggagagagcctggagaaggtcagtggtcagcactagaggtgtgccaaaggacagcagtacctgtcaggagagcagtacagatgtgtgcatgcatgtacacacacatgcacacacatgttaatatacatacatacacacacacacacacaccaccagtgctctaactctcaaatctaacactactacccaggagtgtttgttgggaggtagagtaggcaggccacccacaaccgccccaaacactgagtcattttcaattatgtgcgtgaactagttggcaagatcagtcagaaagtctgcagtcacaataatcgtggcctaagagggtctctactgatggcctgtgctagtggttctcagcgtattgttcctggaccaggaacatcagtagtacttggaccttgttagaggtgcaaattctttgctcttctccctactccctgcatcccagactaaataagaaactctgggggtaaagcccaataagttgtgttttaacaagtgctcagggtggttctgctgcagggaattactgactgatggatgcatggattccgttatccacccattcatttattcctgcattttttcatccaaccctaaaagaggtaaccaaaacagaaacaatcctatgtgtaagcatggtatatcttctctgcttcacccagcaaagtgatatgaaaatgcattgcaaatgtgtttacaaataaagctcctttcccatcagggaggattcctagcgctgtcagcaaaaaaatgaagaatgctccaagataggcctcgagagctattgtgaaacagctgctgatggaatgaaatctgcttgctgtgcctgataccaggctgggagtgtcataagatccttttcacaacttgctcccacactcagtcttgtcagtgcaaaacaggcatgtccaaggggtcaccagattagtacagcacaagactccactgggaaagaccttggtggattcagcaaatgaatgactccctgggagtcagactctcagccacacccaagacatgtcctcctcttttcttatacaccttctttatccatgagcacacccaaacccaacatccttggtcctgaccatgggggactttagctgctgtgtaaagctcctgaaactcaagggtagaagagatatgttttaagaatacacagggtttgcctcaaccttgaccaaaagcaggtctgcctgttgggagggcccatcagagacagcaacccatccttgcccccagttttccacccctgtaaaggcttcccagacctctctctacctctatcatcctgtctccaggccactgtcccctggcaaagacactgctatggtttggatgatggtgacccctccaaaatttgtgttgaaatataatccccaattggccgggtgtggtggctcatgcctgtaatcccagcactttgggaggctgaggcgggcggatcacgaggtcaggagatcgagaccatcctggctaactcggtgaaactctgtctctattaaaatacaaaaaatcagaagggcgtggtggcaggcacctatagttccagctactttggaggctgaggcaggagaatggcatgaacccaggaggcagagcttgcagtgagccgagatcgtgccactgcacttcagcctgggtgacagagtgagactccgtctcaaaaaaaaaaaaaaaaaaaagaaatataatccccaattaaacagtattaaaaggtgtagccttttggaggccacatcttttaagtcatgagggctctgccctcataaatggaattagcacccttataacaaggctcaaggttgaagggagcactctcttgcccttctgtcccttccatcatgtgaagacacagtgctcctcctctctggacaatgcagcaacaaggtgccatcttggaagcagagggcggccctcatcagacgccaatcctaccagcaccatgatttcggacttcacagcctccagaactatgagaaataagtttttattctttataaattatgcagtctaagtatttttgttatttagtttttatttcataatcataaacttaactgcaatacagctagacatggaaggaataaggaaaatatggaacccaaaaaactgcagtgggagtacccagattagaggatactgtgagcaaatgagttggagtgctcttctgagctacagaaggaatgatctggtggttaaaacacaagtcacatttattagagttatctacagtccgcaatagttcttgtcggtcttgccattcctgctcccaaagtgctccatggcttccacgatattcatgccctgtttccccttgccaaagatcacatggttgccatccaaccactcaatcttggcagtgcagatgaaaaactaggaaccatttgcgttgggtccagcattttccatgaacaagatgccaggacctgtatgcttcaggatgaagttctcatcatcaaatttctccccatagttggaattgccatcaactattaaggcatgtgaagtcaccaccctgacacataaactctgggataattctgtgaaagcaggaacccttataactaaattatttctctccagtgctcagagcatgaaaattttctgctgtctttggaactttgtctacaaacagttagaagatgcagcccaagggctcaccatgggtggcgatgttgaagaacatggtgagtttgactgtggctggtggcagaggtctctgtgtgtcagcggcatctgcaaagcagcccaatcttaagtattttgttataacagcacatacagactaagacaacttccttgaccaaactttaattgggctcatctgagcattctgcttaaccagggcatgaccttggtctgccattaggcaagaatcctgctaagttattttagagagaatctccgcaccttttatatctaattacctttgatatctgatcaagtttcttattccccacccttgatgtctaagtccttggcttccctctaccaagaatcctattagacaattttagcaagaatccccctacccttgatatctccttttgttaattctctatccactgaccttttcattcttctcattggcaatacatctatagctatctttgctgaatttggagtaagtgcaatctctctcccctcttgtaatagtcttgaataaagtcttccttaccatttcaataagtgccagaataatttctctgttatctgcagctttattaaggtataagtgacaaataaatattgtgtatattgaaggtatacgctgtgatgatttgatatatgtatacagtgtgaaatatttaccagaatcaagttaattacaacctcatcacctcacatagttgccattttgtgtgtgtgtgtgtggtaaaggcacttaagatctactctcttagcaaatttcaaatatacaataattattattgactataatcactatgactaccaacagaaggacatactgcttgccctggctgtctccttccccttcctccaagctcttggaataacattgctgtcaaaaagttgtgggtaaaatgcagatgtgtatatgtacacagctttatttgagattaaatttaggagttaaaattttagaaagtaagacatgatgtattttaaccataataagtaagatcttgaaataagaggaaggacacaaaagataacatttctacatcattatcatttgaaatattactattcttggcattctcatgccaaagtatctccaaccccagccaatggtatatttgctatcctggattttctgacattatttgtagagtactgggctggcagtcaaagctccccccactatggataaagaccacattttcagtcctgttttccaggaactctgtgctcttggcaaatggcacaattttctgctccctcaaaagactccttcatttttccacaatgctttagcatgctagggttgaattttcacagggcttggccttggcacacacatgatgtcaccacatcctcagatcaaacccatgaaagagcattggtacccagttttagaggagaagaaaacaagtcttgaggagagtgtcttgccagccttgtctttgttaaagaaacagattgctggagattagagaagggtggaggaataaagttgttttggtgttaaattacaaaatgaatataaatcttgaatacatgttcaagttacataaatggtgtttattattatgaagtctcgttagcagcactggcataaatttgcccctccagctctatttccagattcctttcccctacccctatctattttgtggagggaggatgtgaggagggaaaagaggagagggtgggtatgtggcgcctaccctggggaggagagttctgtacttgggtggtagctacaaagttggatgtagttaaagtgagccacctttccccatgcagattcccttgcttggcacgtagtaggcacaaacacatgtttatttccaattgacagttgtctttattgattgtgattacattttttccttctgttgcagaagaccttactgctgatagcaccatcttcaaatttgtggaagcttatgtgagttggataggaaaatttcctacatataatgttggctcttccatttgtttctaatttagtatttctcaattgatattttttttgttgattagaaaaacaattttacttcctgcagaatatactgaaaatgtttttacttcctctttgaaaccactttttatttcttcagccaccctgatttcttgtctcttggttttttttgagcagatttttagtccctttttaatggtctcataagcaagtgtgttcattttgctcattcaattttacctgtaagctatgctagggccttcatagaagctgactgagtaatacatgaagaaggatagacatgtggtatgtactgtgggcagaataaaacaagggggcataaaatggcaacttcctacattgcttccactagtatctgtagtggtatatatctgccctttgaagggagcaatttgtttgaaagtcccttatgagttatctgctgttgcataacaacttacccccgaacttagctgcttaaaataataattttttattatctcacatatttctgagtgtcaggaatctaggagtggttaagttgggtgttttgggcttcaggtctctcatgaggttgcaattaagaggttggctgaggccagttgtggcagctcacacctgtaatcccagcactttgggatgctgaggcgggtggatcatgaggtcagaagttcaagaccagcctggccaagatggtgaaaccccatctctactaaaactacaaaaattagccgggcgtggtggcaggcacctataatcccagctacttgtgaggctgaggtagaagaatcgcttgaacccgggcagcagaggttgcagtgagccaagattgcgccactgcactccagcctaggcgacagagtgagactccgtctcaaaaaaaaaaaaaagtcagctgaaactgaagtcatttgaaggtttcgggttaaaggatccacttccaagacagttcacagagctgtttgcaagatgcttcagttcctcatcatgtgggtctctttacagggctgcttgagtgtactcatgatatggctgctggcttcctccagagggaatgatctgaaagagagagagataaaggagaaagctgtgatgtcttttatgatctagtcacacactgttgtttttgccagattctattagttggaagcatgtcactaagtccaacccatacttaaggggaaggaaattagcatacacttttagagggaataatatcaaataattgtggacatctttttaaatcaccacagtccccttaattttacctacctattacctattcattcaacaaatattttctgaacatgcctacttagtgctgggtcctatgctaaatccaaaggatccagtggtgagaaaataacagtaagaacatcgactaaaccctgacaaggtttctcttgatgtctacagacagagtgggaggtgaagaggtggtcagacaacaatctgataatgaaacaaacaaatgtgaagagaagacgcttagatgatgttggccctgaattggaaaaggctgtctgggagctcggctgcccacccagcattcagtgtctgctacctcctgtctgttatgcttgtgtctggttttttcaagttttaattttttttttaattcttagtttttgtgggtacatagtaggtgtatatatttatgggttacatgagatgttttgatacaggcatgcaatatgtaataatcacctcatggagaatggggtacccatcacatcaagcatttatcctttgtgttacaaacggtccagttagactcttttagttattattaaaatgtacaattaaattatttttgactatagtcaccctgttgtgctagcaaatactaggtcttattcattctttttaactattttattgtacctcttaaccattcccacttcctccccaccacacactatccttcccagcctctggtaaccatccttctactctatctccatgagcttaattgttttaatttttagctcccacaaataagtgagaacatgcgatatttgtttttctgtgcgtggcttatttcatttaacataatcacctccaggtccatccatgttgttgcaaaagacaggatctcattctttttatggctgaagagtactccattgcgtataagtaccacattttctttatccactcatctgttgatggacacttaggttgcttccaaatcttagctattgtaaatagcactgcaataaacatgggagtacagatatatgttcaatatactgattttctttcttttgattatgtgcccagaagtgggattgctagatcgcatagtagctctgtttttacttttgtgagggaatctccaaactattctccatagtggttgtactaatttacattcccaccaacagtgtacaagggttcccttttctccacatccttgccagcatttgttattgcctgtcttttggttaaaagccagtttaactggggtataactggggtaagatggtatctcattgtaggttttttgttttgttttgttttttgttcttttgagatgaagccccactctgttgcccaagctggagtgcagtggagtgatcttggcttgctgcaacctccacctcccgggttcaagcgattctcctgcctcagcctcccaagtagctgggactacaggcacatgccaccatgcccggctaatttttgtatttttaggagagacggggtttcactttgttggccaggttggtcttgaactcctgacctcgtgatctgcccaccttggcctcccaccaaagtgctgggattacaggcgagagccaccgcgcctggccgtttttttcttttctttccttttttttttttttttttttacagagtcttgctctgtcacccaggctggagtgcagtggtgcaatcttggctcgctgcaacctctgcctcccaggttcaagcaattcttgtgcctcacccacgcagctgggattacaggtgttcaccatcacactagctaatttctgtatttttagtagagacgggttttgccatgttggccaggctggtctggaactcctgacctcaagcgatctgcccgcctcagcctcccaaagtgctgggattacaggcgtgagccacctcgcctgggtcaaatcaccattataactttcttgtactttgatattggtaccttctctaggtttcagaagttctctgttattatccctttgaataaactttctaccccatctctttttctacctcctcgttaaggtcaataacagatttgctcttttgagactattttctagatcctgtagttgtgcttcatttatttaaattcttttttcttttgtctcctctgactgtattttcaaataccctgtcttcaagctcactaatcctttcttcttcatcatccattctgctattaagggactctgatgtattcttcagtatgccaattgcatttttcagctccagaatttctgcttgattcttttaaattatttccatttctttgttacatttatctggtagaattctgcattccttctctgtgttatcttgaatttctttgaatttcctcaatacagctattttgaattctctgtctaaaagatagcatgtctctttttctccagaattggtgcctggtgccttatttattttgtacggtgaggtcgtgtttccctagatggtcttgatgcttgtggatgttcatctgtgtctgggcattgaagagctaggtatttattgtattatttacagtctgggcttatttgtacctatctttcttgggaaggctttccaggtattcaaagggacttggacgttgtgatctaagctgtatgcattaggaggcaccccaagcccagtaacactacggttcttgcagacccatagaggtactaccttggtggtcttggataagatctggaagagttctctggattacccggaagagactctttttctcttccctttctttctctgagacaaacagagtctctttctttctctctgtttttgtgctgagcctcctggagctggaggttaagcgagaaaagtacacctgtggccagcaccactgataattttctgggtcagacctgaagccagcacagcactgggtcttgcccaaggccctctgtaaccactacctggctaccacctatgtttgctcaaagccctagggctctacaatcaataggtggcaaagccagttaggcttgtgtctttcttccctccccttcccacaggcagataagcctcactccatggtcactgccaccacaggcccatggggaagtacttccagattaccatcaatgttcacttaaggcccaagagctgtgcagtcagcttgtagtgagtgcttccatgcctgaggctcgtccttcagggcagtgaactcccctctggcccagggcaggtctagaaatgctgtccatgaggcaaggcctggaatcagggaccccaagaacccactttgtgctctacttccaaggaccaagctcatacctaaggtgcaagagaaagttctctttacttttccctccgcttttctcaaacagaagcagtttttcaccatagccaccagagttggcaatgtgctgggtctctcctgaaaccagcacatctcagaacccaaggcccatagtgtactttctggatattgctgctggttattcagggatccagggctcttcagtcagcaggtgatgggtcctgccaggacagagtctttccctttaagggagtggggtcccttttggcccacagtgtgtatagaaatgtcatttgggagctaaggcctggaataggggcctcacaactctgcccagcaccctatcctactgtgtctgagctggtatccaagatgtaagacagtcttctttactcttccctctcctctacagaaatggaaggaagagtctcttttaaagctgtgagctgtctgcctggggttggaggtggggtggcataagcgttcacttagcctccctggcttgtgtctcaataggtcatgtgaccctcagtcttctggctctgggcccagttcagcactaggacatgcctaggaattgcagtccttttggcctagactgtctttcaagtttatttagggccccagaacactttagcctgtggtgataaggcttgtcagaactcaagttctgaccactgggatgggtaatttccctctggctagggatggtctaaatgctccctctgtgggcaggcatcaactgagttcagcctggttttgctttctgctataacggggcatcactgagttcaatgctaagtctcatgatcactgcattctccttctcccaagcacatgaattttttctccatgtcatgtggctgctgccaggagatgggggaagggtgccatcagcaattcatgatggtctttcctaccctcttcagtgcctctttcagggatatgaagttaaaaccaggtactgtgagtactcacctgatttttagttcttttgaaggtgcttttttgtgtagttgataaatttggtgttcctgttggggagatgatcagtggagccttctatccagccatcttgccctgtccttctccatgtatgtattttgataggtgaagacacaagaccaaaatgtgcttcccagagagcatgaatgaatacaatacttactctggacactgatctagaaagtccaaagaatgaaaggaaatcctaccaattcatttaaaaagaatgtaatgttttttctctcaactctatgtcaacgtaaaataaccaaaaagatcacaatctagtttgggagtttattcaagtgaaaaggttgaggacagcctgcccagtaagcacagatttcaaagaattcaagtcagtgttccaaagagtagaagttcaagatcgtttatatagataaggttcagggaagtttaacagaatttcattgtctttctatggaagccttaatgtataattacaatgatacaattggtcaaggtggtctttttcttttaggaaaggtatatttaacattccacaccgaatatataactgtcatggggtacctatttgggggtgttatccgatctgagttagatgcaggacaataaaggaggcagttggtctataacaaagatcagtgattggaagggggaagtctagtctctgatctttcctagttatttacagagcaagaacaatgaggaagagagttaatctgtgatctaagaagcagaagttataaatacgtgctacatgactcagatcacagttacatctctcttaagtctttaaatgtcttgaggcttccaactgcttttatattttattttcacaactagtcccttcagaacaactcattatatcatgcagaaatagtattaagttatcacacaatgtacaaaatattatttattttcctttttgctgttaaatttccataggttctccatgacatggttgggctggtttttttggtttgtttgtttttgtttttgtttttgtttttgttttttgagacagggtttcactctgtcgcctaggctggagtgcagtggtgcagtctcagctcaccgcaatctctgtctcccaagttcaagtgattctccttcctcagcctcctgagtagctgggattataggcgcacaccaccacacccggctaatttttgtatttttagtagagatggggtttcgctatgttggccaggctggtctcaaactcctgaccttaagggatctacccacctcggcctcccaaagtgctggaattatagatatgagccaccacgcccagctgggctgtttgttttattattattattattattattttcagaaaggaggtagtagggagggagaaaacttatattgaatgagcaattacaacacaccggttactttatataggttttcttatttaattctcattaccaccctgaaaataaagtactattatcaccattttacagataaggagatgaacagttagaacggttagatagttttttttaggatcactcaactagtgagtggaacaggaaggactcaaatacagactttgtttaactgtggtgtttattatggtgcttcattttgagatggtgtgctttcaagatttagggttacattgatttgagcttgctaagtcatagagttcttttttgattaaatgccaaaatgaatataaatctttaccatattttcatgacacaaaaatagtatttgttattatgaagggccactaacattaatactctgagctccatggctctaagcccctaattgctcagtttcagtaaatttgatgttctatagacccatgcttctcaaactgaaatgtgtaaacatatcacctggggtatgtggttaaaatgcaggctcttatccaataggtcccgagtggggcctaagctgcatgtctaacaggctttcacgtggtgctgatactgcttgtcttcatatcatagtttgagtagcaagactgtggagtagcaagacttaaatactcttgaaattcccggggtacttccagcagtctaagaatttgtagacacggacaaggatggctagctgtgctagaactctgaggcttctggtcacagctgttttacaggggttctcctctacaccagaactctgcttgtggtaccacttctatctcctgtatatgagtggatttgctatgccaaatccacatagcagagtggaaatctgctatgccaggtattactggatctgcatgctattgcagtcccttgatgttaattataagaggatgatgagcaatggcagcctagaagagggtgaatcagagaggcaagtacgataggtatctggtgcttgatagggaggagagagagggagcctggaccatgaagagttttagaaagtttaaacttccctatatacctctgtaagccagatgttgagtaaggttttagagatatagcgtcgttaccctcaagaaaatttcagcctggaggggaagactgatgagtaacctacagaacatagtgatgggtgtaagtttagggcattatcagagcctagagcagagccatttaactcacacttgggatggggtggggaaggagcagggcagtggtgtgttggaaaatgtttaacaatcagttctctgaaaaaaataaaagctctgatctgtagtgtttgttgacttccatggtgtaaatacttccatcatggccaatttctttttttttttttatttttttttgagatggagtctcgctctgtcgcccaggctggagtgcagtggtgtgatcttggctcactgcaagctccgcctcctgggttcacaccattctcctgcctcagcctcccgagtagctgggactataggtgcctgccaccacgcccagctatttgtttttgtatttttttttttttcagtagagatggggtttcaccatgttagccaggatggtctcgatctcctgacctcgtgatccgcccacctcggcctcccaaagtgctgggattacaggcatgagccactgcgcctggctcatcatggccaatttcaaggtactatcttgatgtcactgaacaaagaattgggaagagatgttcataattggctcttgtaagtcaggccaagctgactctaagcacaccattgaggtagtgaatccttcccaaagtaaatgtctttgtcaattcgggctgtcataacaaagtactatagactggatggcttgtaaacaacaagagtttattcctcacgtttctggagtctaagatcagggtgccagcatggttgggctctggtgagggccctcttcccagggttgcagacttctaacttttcactgtactctcacatggtagaaagagggcaaactagctttctggcctcttcttataaaggcattaattccattcatgagggctccatgcttattacctaattacctctcaaagtccccacctcctaatattatcacactgggcattgggatttcaacatatggattttttgagggaaggagggacccatttagaccattgcagtgggaaagaagagatttgaaggataagcagaagttagcccatcaaatgtagaggacaaatgagaggattccaggtagaaggatggcaggtgcaaatgacccaaggtaataggaaacatggtgctttggcagtaagttatgaattagagtggaagtggacagtcctaagtctccaagtaggcaaacatataattacagaacacatttaattttactctcttttctgatcccattattgcatttgacaaatcatttccatcaaactagaccaatgctgcatttatgtctgtgatgagcttaaatcttagtaaggacattaattgaatctatttgtattttttttcaaggtattaagcaaatcatcttattagatactccacaaagagcatatttgtagtaagtaatgacacaattttagattattaccactaaactcttttaaagataatttataatctacttaagaattacacagctatcacaatgtgcatcttaacaaaggcacaaaaagataatgctcctccatggtttattatgattttgtgtataaaaagaagatatatgaatactttttttctcaactttcattttagtttcgggggtacatgtgcagatttgtcacatgggtaattgtatgttgctgaggtttggtgtataaatcatctcaccacccagattgtgagcacagtacttgataggtagtttttcaaccctcgcccccctccagcctcccgtctagtattccccagtgtctgttgttttcatctttatgtccatgtgcacccaatgtttagctcccacttataagtcagaatacgagacatacggttttctgtttctgcattagtttgcttaggattatggcctccagctgcattggtgttgctgcaaagaacatgatctcattctttttttaatggctgtgtagtattccattgtgaatatgtaccacattttctttatccagtccaccgttggtgggcgggtacccgggttgattccatgtctgctattgtgaatagtgctgcaatgaacatatgggtgtgtgtgtctttttggtagaacaatttattttcctttggatatatactcagtaatggggtgctgagttaaatggtcgttcaactctagttctttgagaaatctttaaagtgttctccatagtggctgaactaatttacattcccaccaacagtatataagtgttcccttttctctgcagcctcatcaacacctgtttttcttttttttgctttttaacaaaagccattttgactggtatgagatggtattttattgtggttttcatttgcatttccctgatgattagtgatgatgagcacttcttcatctatttgctggcctcataggtgtcttcttttgagaagtatcgttcatgtcctttgcccatttttaatggtgttgttttttgattgttgaattttaaagtactatagatatgtacttctttttattgtgggctttttcaaacctacataaaaatagagtggtaatgaattgccatattctcaccaaccaacttcaacaattataaactcataactaatctcatttaatccttctaaagagtttggacttaaaaatccataacttcagtgttattattattcatcaaacaattaacaatattccttaacattattaaatcttcatttagtgttctaattttcttaattgtctaatttttcctttataatttgtttaaaacaggattcaaagtccatatattgtattttattgactttttaaaagtttctcttaatttgttggttctctgtgtatttttattttaaataaaatatttattttaaataaaattttattttaaaattattttattttactttgaggtggggatttgctatgttgtccaggctggtcttgaacttctgggttcaagtgatccttctgcctcagcctcccaagtagctgggattacaggcatatgctactacacccagctttattttaaaattatttcaacttctttgttgaagaaaacaggttaatttagcctgtaaaattttccacattctggaatttactgactgcatccctgtggtattgattaacatattattttgcttcctagtttcctgtaaactggtagatctagaggcttgttctgattcaggtttgattttctggaaggaatatttcataaatgttatttgtatttctttcaagaggtacatactatctgactgaaggtctcttttttgtgatgttagtggccatcaatggtcatagcctagattcattatttccttagggatttgtaagatggtgatattcaatttctgtaattccttcttcatttattggttaaaaaaaatggccttggtgcagtggctcacgcctgtatccccaacagaggcagaggtgggcagatcacctgaggccaggagtttgagaccagcctggccaacatggagaaaccccatctctactaaaaatacaaagttagctgggtgtggtggtgcatgcctgtaatcccagctactcgggaggctgaggcagagaatcacttgaacctgggaggtggaggctgcagtgagccgagatcgcgccattgcactccagcctgggcaacaaagcgagactgcatctcaaaaacaaacaaacaaaaccccccaaacccccctttttttagacggagtctcactctgttgcccaggctgaagtgcagtggcaccatcttggctcactgaaacctctgccttctgggttcaagtgattctgctgcctcagcctcctgagtagctgggactacaggtgtgcaccaccatgcccggctattttttgtattttagtagagacggggtttcaccacgttggccaggctggtatcgaactcctgacctcaggtgatccaccagcttcggcctcccaaagtgttgggattacaggcatgagccactgtgcctggcctaaaaaaccttctgtaaatggaaaatttctctcaataactggtcactgtgaggggcaatttggattcccttagcatcatccttcaaaggtggccaataaagattttttttttgatattattatgaattcttagagttttaacatattcgatgtgtttcgactcatcagttcattgcagttgttatttttaatgatgctcaaatttgctgttgcaatcattttcaagttggctcctgaatgcttttgacacaaccccactagcccttgatagctttcttgcttggtaactagtaaaataacataaataagtaatttgaaatatttatgacatgttaactgcaaaattgtgattctaaattaccatttcgttatgcttcatataaaaggaaataaaaactacccttgcatccaacctatggaatgttaagttgacacataagacagtcaaagcttcctttaattcaatatccccccccttttttttttttgagacggagtgcaatggcatgatctcgactcactgcaacctctgcctcccgggttcaagcaattctcgtgtctcagcctcccgagtagctgtgattacaggtgcccgcccccacgctcggctaatttttgtgtttttagtagagatgggattttatcatgttggccaggctggtctcgaactcctgaactcaggtgatctgcctgccttggcctcccaaagtgctgggattacaggcgtaagccactgtgcccggctcaatatcctactaatttctagctttactaggcagctagtgcatgatttcctcttctaaacaaagcattgatacttatctaaataaaataaaataaaattaaattaaaattaaaatggaatggggtagaatctcttccttcttaaaaatgtgttcctggagctactaaaaaacttggattttcaaagtccttgataaaaaccattcccctatattgtagaagggaagtattgggacccctgataatactgggtataagtatgctattcagacttggcttctttccatcctgctgcatcagaggctagattcaccttttatgttttccctttcttgccgtctttagtgtcttgtttagccactccagtgagtttcccttttgcccttcctttcccttatgtttgtactttttactgaaggtttatccttttactttgccttttgtttatgatttaattttaacttctgcaggagcgggtttgaacgactaccttcagatcttctcttgggctctttatttagcacctctttagctgaattgactttcttcttataaatcttggcaatggctgcagtggggagggcaggtgcctgggtgcctgggtgcctgtgggccttcatgaagctggcctacctgtatatttcatttcttgcttatatttccagatgctatctataatagctatgtagctataatagctataatagctctatgcagtttatatcaaagtcttctctttatgtgagaaagaaagcagggtaggccaggactaacatttggtgaagtccttttatgtgtcagacattctttgttgattttctcattatgttctctcttagagtcacgtaaaaggtaaaataaggagggcaagaaaacacaattttttaaaaaaggaaatggcatagggattttctatttttttctcagccccagaaggtaattactcttacaatgcagaagtatcaccagatactatctgcacaggttttcccattttttcctcacaccactgtggtaaagcagggggatctgtcacctccactgaggagactgaggctcacaagaggtgataacatataaaactctatcagtcatttatggagtggagcagaggctctcaaagttcagcatgcatcatctgtaggtgtataaacactaattgctgggccctgcccctagagtttctgattcagaccatctggttgagacccaaagatatgcatttctaagaagttcccaggtaatgctgatgctactgctctagggaccacagtctgagaaccactggtctggctaatagacaaacaaacaaataaacaaaacagcatttattctttacaaggtacatagagaattgcactgagctgagaggattggtggaagtacatggcctggagtcaaagcaaaggggtcagagtttgcagtgtacctaggcccatgacctgggccattcactcaggcagggggtgacactatatcattctcctaaaatgtaagggaaccagtcactggtccttagaacagctcatgtgggcattggtgatttcatcacatctcttaccctggggagcctggtgggtgagggattaagctccaggctcctgggatctcccttgatcttagctattcaaattacttattattaaatccgtaattcagatcagggtataggaagttaggagatgttaagtaaatcagggaaactgtcttataaatgcttacttagtagtgaaacctggaattactgtaaagctttccccatggtgtctggaatccaccagggctctaagtactccaatctgtctgggtaactgatgctgggcggggtatggcttagttttttaaaatagtgaaatatattacttttaaattatattattactgaaaaatttaaaacacagtatatggcaaaaaatcagtaaagcttgtctaaaatgatgacagcaaatatttgcaaactattaatatatgtagctaattcttatgatataggaaaccttcccagtagccaatataaagagatggacaaatgaggtaagcagcctctaagacggtgatctcaatgagccatgcctcctagtgttcatgcacttgcataatccctatccttgagtgtgggctggtagttaggagaggcttaaataatgaaaactgaaattactctaaagcttttctgtttgaagcctccagggctctgaatgctctgatttccctgggtgctggcacttgatgctctccatggtattgctcaatttctgttataatgaactgttttatttatttatttgtacaatataacataatatttaccattttaatcattttaaagtgtacagctcagtggcattaagtactctcacattgttgtgcaaccatcaccactgtccatctccagaactcttcattttgaataaaactctatacccattaaatgataacttcctattctctttttccttagactctggcaaccaccatccttttctctgtataaatttgactactctgggtagttcatacaagtggaatcataccacttttgtccttttgtgtctggcttctttcacttagcataatgttttcagagtcagcatgtaacagactttccttcctttttaaggctgaataatattccattgtatggatatactgtcttttgtttatccattcatccattcgtggacatttggtggtttctaccttttggctattgtgagtaatgctgctgtgagcatgggtgtgcaaatatatgttcaagtctctgtttcatttcttttggctatatacccagaagtggaatttctggatcatatggtaattctatgcctaatattttgaggaactgccatactattttccacagtggctgcaccattttatattcctacaagcaatacacaagggttccaatttctccacatcctcaccaacacttaactattttctccctctctttttttttaaataatagccatcctaatgggtgtgatttattatttatttttaaaactaaactttattttgtaataattttaaatttacaaagctgtataattttaattaacattattgaaaaatttaaaacactgtgtattgcagaaaaaaaggtaaaagttatgtgaaaagtagagagaatatttgcaaactaatggggcttatatttgtgatatgttaggcagacttactgaccaacagtgggtcaatgatgtcaaaagaaaattcactgaaagagcaatatttatgtcagtaaacattgctaatgaaatatcaatgaaagtcagagatatattaagtgaaataggaaaattgcagaagaatatgttatgactacagttttgaagaatatgtgtattttgtatattttatgtaaatatttttctttatatgtagctatacagtagtaaattacgtgtacataaacacatctggagaacatgcacctattttcagtgaaaatctttgggtcagggagtgagagtcaggcagatgaaaggataaatttaatttacacatacacctttttggcttgtttgaaattttgtaatcaggaacatttattaagataaaaatttgtaggccggcgcagtggctcacgcctgtaattccagtactttgggaggctgaagcaggcagatcacaaggtcaggagatcgagaccatcctggccaacatggtgaaactctgtctcaactaaaaatacaaaaattagctgggcgtggtgatgcgtgcctgtaatcccagctactccggaggctgaggcaggagaatcatttgaaccagggagttggaggttgcagtgagccgagattgcaccactgcactccagcctggcgacagagtgagactctgtctcaaaaaaaaaaaaaaaaagataaaaatttgtaaagagcaaaaatatataacccccccaaaaattagatacacatatattatgttttggaaatatgtgtacagtatactggtttcttgggaaaagagcagattaaagcaactgatttggtgatgtatctacttatgtgtgtgttgctatgtctcaaacttcttcaccccaaataatcacacactcacacatgcagctttcccttcagctcaggctggaagtggatgtctagttttagggcttagagaccacagaaagtcctatattcagaggattgctgccagtgggtggtcattccagaaagatctggccggtgccaataagtccaagcctttccctcctttcctccttcccttgcaaagccctctgtcctgactttcataattgcaactctgattctaatcaccaggtggctccattctgtctctctttctccatcaaggttggctgatgtccacactgcagagcactctctggagagaggaggtggttcaagtcctcaaataccatacacctataatgacttcccgaatcaggccactttacatacagctgctcagaacggtttccctgaagttagctctaatattgtcacacaaacaccctcagaggcaatccactacccacccaagagaactatgcactctttcccagctggcatgcaaggctcctcatcccatggatccagactacatttccagcactctcttgcaagtgctcttggcaaactgtaccactgctcctctttcaagggactcttgtcttttttgtgtgcctctccattaggttaggggtcaatttgcatagactttggcccctgcccacacatgataacattaaatatttagatcaatcctttgaggagggattgttatcctcattttaaagaagtggaaactgaacctcagggaaagtgagaaccagtcttgtcttcgggaaagacactggggttatagaagtaagagacccagtggtagcttggtagtgataatgaacagtattattttgctctataacaaagaggaatggataaagtgcttgctacaattaagtgcctactatgtgtagtattaattttattatttatttatttatttattgagaggcggtctcactgtgtcacctaggctgaagtgcagagtggcgtgatcttgcttcactgcaacctccgtctcccaggctcaagtgatggatcctcccacctcagccacccaagtagctgggaacacaggtgtgcaccaccatgcccggctaattttttttggtatttttggtagagataaggtttcgccatgttgccccggctggtctccaactcctgagctcgagtgatccacctgcctcggccttccaaagtgctgggattataggcgtgagccaccgcgcccagcctattttttctaagatttaaataatatgtgttcaggctgggtgcggtggctcatgcctgtaatcccagcagtttgagaggcagaggcgggtggatcacctgaggtcaggagttcgagaccagctttgccaacatggtgaagccccgtctcgatgaaaaatacaaaaaaaattagccaggcgtggtggcgggtgcctgtaatcccagctacttgggagcctggggcaggagaatcacttgaacctgggaggtggaagttgcagtgagctgagatagcgccattgcattccagcttgggcaaaaagagtgaaactccgtctcaaataagtaaataaataaataaaatgtgttcattgtagaacatttagaaaatatattaaaacagagagagaatgggaatgaacacccacaataccacaactagaacagcccatccctttctaggatttgctaacatcaagtggtaggttcaagaatgtcaagttatacctataaaataagtgaagataggtcaagagagggtgaaaacgtttccaggttccatcttactctgactccaatatgcacaactccaattttactgcattgcttccccttttagatgatggatttctagatttctagagctcaggatatggctgtgttacatttgtttggaatggtgcacatatattatgaaatgatgcgtatatatgggtaccagtttatgtatctctcttgatggagataaaatccctttctttgtgctaaagggccaaggtgtatgaccaacatcacttggtctccaaggcagtaatatatatagaaaatctcacaggctttggaatcacagatggagtgcggaatgcaggcaagggatctaatacttatttaggagtgtgctatagtcagacaatgtaaaatttatactaggcttgagtaatgtctaggatgtattttttattctctaaggtaaccactacatgaatagtaatagaatctataattaacaagataatggggaaaatggaattataaaaaaccattatgcatttcaaaagagggcaagagaaaagagaaaaagcaatataaaacaggaagaacaaatacaaagcaaaaagtaagatggtagatttaagccccaaaataccaaatataccatctatataatatatattataggtaagcagcctaaacattccagttaaaacacaaaatcagaatgtattaaaaaataactacatgttgtctataagagatccacttttaatatgaagccacagaaggctaaaagtaaaaagatggaaaaagatatgccatgcaaatattaacaaaaaagctgatgtagttgtattaatatcagataaagtagactttaaagcaagaagtggtagtaaagacaaaaagggacatttcgtaatgataaaagagtcaattcagcaggaagatcaaataattctaaatttgcatgcatctaataatacagcttttaataatataacaacattatgtttgtgagattcatccatttggttacatgcggcagtagtttgttcattattattgccgcatggtgtttcattgtataaacttttctcagtattggtaaaataagacaaaaataagtaagactaacaaatatttgaattgcacaagtaatcttaacataactgacaaatgtagaaccctgcactctaaaactgcagaatacagtttatttttaggtacaaggagcatctacaaaatttcactacatgaaaggcataaatttagtctcaacaaacagcaaagggtgaaataacacagtgtatatcctttagctattgcaaaattaagctacaactttaaaattattaaaattataaaatgtctagaagaaaatataatagaaaatatttgtgatcttgtgtttggcaaactttttttggtaggacacaaataggacaaaccataaacggtgaataaataaactggatgtacccaaataaagactactgccctttctaagatgctgttaaggaaatgaaagctgaactatagacagggatgaaatatttgtaacttaacaaagctaataaaggactttatccagaatatataaagaactctcacaattcgatattaagaaaacaacaactgaattttaaaaatacaggtaaaagattagaatatctgcatctgttagagtggctttaaaaatgacaaaaccaagtgcatgtcagaattggagcaactggaactctcatatgattctagtgggaatgtaaaatggtacagccactttggaaaagagttttgtatagagttaaacatacacttcccatgtgactcaacaatcccactcctcagtatttacccaagagaaataaaaacataggtccacacaaagacttgcatgcaaatatttatagcagctttcttggtaattggcctaacctagaaacaacccaagtgtccatcatctggtgaataaataaattgtactatacaatggcatactacttagcaataagaaggaccaagcaattaatacaagcaacaacatgaatgaagctcaaaagcactatgttaaatgaatctcagacataaaaagtcttgtttcatttatatgacattccgagaaaagcaaaagttataggacagaaatcagatcagtggttttttgggggtgctgaggctgaagagagagggttgactatatggtacaagggcacttggtggggtgatgaaaatattctgtatcttgatcgtggtggtagttacatgactacatacacttgccagaactcatagaactttacaccctagaagaacaaactttactgtgtgtaaattatacaccaataaacctgattaaagtgatcccttttgctaatttgtaattaatctcttttgctaatttgcacaaagccatgtgccaactgggtggcatcttcctagaggaatctcttttgtctcatttatgcaaaggcaacaaatgagatagtagtggccttatcttattccatattgaatcctttttatttttgtatttttaaaaattttggtaaaattatatatagagaaatacacaaatattaagaacataattaaaaaatacacttgatttttaaaagcctatgatttttcttttgagacagggtctcgctctgttgtccaggctggagtgctatggtgtgatctgggctcactgcaaccttcacttctcaggttcacgtgattctcgtgcctcagccacctgagtagctgggattacaggcatgcgccaccatgcccggctaattttttgtattttaagtagagatggggtttcaccatgttggccaggatggtctcaaactcctggcttcaagtgatctgcctgccttggcctcccaaaatgctgggattacaggcatgatccaccacacctggccaaaacctatgaatttaaaaaaggctggaaagaaaccatcaaagcatctatctcaaggagctaggaaaaaaatcccaaccaaacagatcaaactgggttaagctggtgatgatgatataattcctcttttgtaaagttatgtttttccctcatggctatagcacctgatgatacaagcatccatccatgatccttttctgaatcaattatttcatggtgggggggggacggtgtcataaaataatctttgaattctatcatttttctatgtgtattagttaacattctcctaatctagaaggaagcactttccctcattaactgggctttttggttacccaaaacatggtttctgctggaaaggcaagtaactgcctaattcttctcctctaatgaaaccattgctccacttagtcattgttttgttgagtccaacagatttagaaaatataagaacttatgttccagttcaaactgttgctttgggtgttagttaagatgaattggtttgattggatagtgctaaatttataattaatttgaggaagaacataatatggaatagtatgtacaatatgatccttgtgtttaacctatatattctcatatagatacaggcatatatgggtaaagtatatggcatttagttaagtatatggtaaatgttgcatttcaagttctaataggggaaaggatctcttcaacagatgctcctgggaatctgggtatccatatgaaaaaaaaaaatcagagtcctatcttatgccacttattaagttccaaatagatttttagaacttagaatagtactatatcagtataggggagtatttttcttttcttttttttctttttttttgagacagggtctcattctgtcgcccaggctggagtgcagtggtgtgatcatggctcactgcagcctcggccttcctgggtccaggtgatcctcctgcctcagcctctcaagtagctgggactataggcacgcgccaccatgcctgactaatttttgtatttttttgtggagaggaggtttcaccatgttgcccaggctagtctctaactagtctcaaacgacccacccgccttggcctcccaaagtgctgggattacaggtgtgaggcaccacgcctgtccttaggagagtatttttcttttcttttcttttcttttttttttgagatggagtctcgctctgtcacctaggctggagtgcagtggcacgatctcggctcactgcaagctccacctccagggttcacgccattctcctgcctcagcctctcaagtagctgggactacaggtgtctgccaccatgcctggctaattttttgtatttttagtagagacggggtttcactgtgttagccaagatgttctccatctaggagagtatttttcataggcttcagttggggaagaaaaaagccataaataaaaagactgatgcatttaactacatcaaaatggaaaaacttcagtatatagaaagacaacacagacaagattaaaacaagctacagactaggagaaaatatttacaacatataaaacagagaaacaagtactatctatactaaatacagcccttctgcaaaatcagtaagataaaggtaatatcttttgtgccaggaaaacaggcaaagcatgtgaacaggcaatttacagagctacaagtaaccaataaacatgtgaacagaggcacaacctcactacttaacagagaaatgtaatctgcaacattgttataccacttatcagttatccaattgtcaaaatttgcaaagataatttttgcagcattgttttttattgcttaaaattaaagaaaacctaaatgtccatcagtagaggaatggctaaataaaccatactatagccacactatggaatacaatacaacagttaaaaggatcaacatttattgacaagaaaagagccccaagacatattgtagaatgaaaatatcaagttgtgaaacatatgtaccatttgataccctctaacaatatttctataggtacatatatatgcatgaaactcatagaaaaaggtctggcatgatacacaccaaactaataaagtggctttctctggagagggaattaaggtatattgaagtataatttatatacaatatatcacacacatcttaaatgttcaatttgaagagttctaacaatcatataatcccatgttaccaccacacaaaacaagatgtagaatgttttcatcatcccgaaaggtcctttgtgcctgtttctagtcaatttgaggtagaaggtgggactctactccaggggtggagctcagacaccagaccaaattgaggactagctaaaatagggactgggctgaagcaggtttccataagacatgcccacccaccagtgcaccatgtcaatttaccatggccatggcaacacctggaagttaccaccccttttctagaaatttctgaataacctgtcccttaatttgcgtataattaaaagtgggtataggtatggctgcagaactgccccagagctgctactctgggcacactgcctatgggttagccctgttccgcaagtgttctgctgctgctgtacactgccacatcaataaaagttgctgtctaatgtcacctgctggcccttgaattcttttctgggagaagccaagaactctcctgggctaagcctcaattttggggcttgcctgcccagtgtcagattcccctctattcccctgaacaccactttctgatttttatcaccacggattagtttcgtttgtttttacgtttcacgtaatggaatcctgcaatactcttttgtgtctggctctgttcactcagcatactggcttttttttttttaacttctcctttttgagacagagtctcaccctgtcatccaggctggagtgcagtggcacaatctgggctcactgcaaccttcaccccctgggttcaagtgattcttatgcctcagcctcccaattagctgggattacaggtgtgcgccaccacacccagctaatttttgtaattttattaatagtagagatggggtatcaccacattggccaggctggtctcaaactcctgagctcaagcaatctacctgcctcagcctcccaaagtgctgggattataggtgtgagctgccgtgctgggccagcgtactgtttttgagatttattcatgttgttgcatatatcagtactttaatactttttattgctgaatagtattctactgtatataggtacaacaatttatttatccattctcttattgtttctgagtttcagctattatgaataaagctgatataaacattcatgtacaagtctttgtgtgggcatgttttcatttttcttggttaaataatactcagaagtgaacttgttgggttgtatggtaagcgaatgttaaactttataagaacctgagaaagatttctccaaagtggctgtaccattttacacccctgatgataatatattagtattctggtttctccatgttctcaccaacatttggtgctgttagtcttttgatttcagccattctagtggaagtgtggtggaatgtcattgtgttttctatttgcatttctctgattactgaagatgttgaggactagatatctaccattgcaaagcatccattcaagtttgtgcccccttttacaatggatttttctttttattgttgatttgtaggagttctttatatattctggatgtaagtcctttgtcagctacatgtactatatgtatatttttccaagcctgtacattacctatccattttgttaataatgtctatggatgaacaaaacataaattttgataaagcccaactttctcttttattatttcaactttcaattttctcttttattattaatgctttttatgctctaaggcatctttgccttcctctaggacatgaagctattccccaattttttatgctagaaaccttatggctttggcttctacttctagtatgctaggaacacggaagaggtatttgtccctctgaaacaggttttatggaacaggctatcagatttagagagaatggataatagaaattaaatgtccatgtctgatagctttgaagagagcagtggttctcccagcacgcagctggagatttgagaacgggcagactgcctcttcaagtgggtccctgacccctgaccctggagcagcctaactaggaggcaccccccagcaggggcacactgacacctcacacagcagggtactccaacagacctgcagctgagggtcctgtctgttagaaggaaaactaacaaacagaaaggacatccacaccaaaaacccatctgtacatcaccatcatcaaagaccaaaagtagataaaaccacaaaggtggggaaaaaatagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacagccggtaccagccgctgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagattcaagacccgtcagtgtgctgtattcaggaaacccatctcacgtgcagagacacacataggctcaaaataaagggatggaggaagatctaccaagcaaatggaaaacaaaaagaggcaggggttgcgatcctagtctctgataaaacagactttaaaccaacaaagatcaaaagagacaaagaaggccattacttaatggtaaagggatcaattcaacaagaagagctaactatcctaaatatatatgcacccaatacaggagcacccagatacataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatttttcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggacgcattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctctcagaggtacaaggaggaactggtaccattccttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcattcctgggatgcaaggctggttcaatatacgcaaatcaataaatgtaatccagcatataaacagagccaaaaacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcagaagacagggatgccctctctcaccactcctattcaacatagtgttggaagttctggccagggcaattaggcaggagaaggaagaaaaaaaaaaaaaaaaagaaaaagaaattaggactgcttggtaggtccaggcacggtggctcatgcctttaatcccagaactttgggtggcccaggcaggaggatatcttgagctcaggagttcaagaccagcctgtgcagcatagtgaaacctcatctctatgaaaaataataataaaaaaataagctgcgtgtggtggtgcatgcctgtagtcccagctactcaggaggctgaggtgggaggatccttgagccctgggagatcaaggctgcagtgaactgtgattgcaccattgcactccagcctaggcaacaagcaagatcctttctaaataaataaataaaaggacttctttgtaggtatctgcaaaagaaaaaagctatgagggctgacaaaagttgggggggtgtaatacaaatagaatgcataacctccaaaccactataggtaaaataaattgatctaacacaaagctggcagtgggcggcggggaggggtgtgcggggaaggaacaaaaaagcatggtaagcagaaaatgcaaaaacaaatggcataaataaatccaaatatattgtaatgacaatgtgaattggttgtattcacttaaaaagagacagtgactctcagattgtgttaaaaataaaaatatacctctgtactgtattaaataagatggaaaaagataaaccaggcaaaaactaataaaaagaaagcagaagctgcattatcaatataagacagagtagaatttcagactgaaaggactaaaggacacagaaggacgcttattattaagtctggttatattacctagaaaatgtaacacaatcgtttatgtagttaactatagcttcaaaatatgcaatgcaaaatagtatatatatatatatggaaacattgttacatctacaatcatagttgggaggcttagcacacctttttcaataatccacagattagcaaaaagatagaggatttaaatttcacaattgatgtgctttaactaatctctctaatataaacaactttgtacacaacagaaaataacattcttttcaaatgcacttggttttaaaaagtgcccaggtattagaacatgcttattcaagagttaaatcccatcaatttcttttttaaaaaagtggaaagagtactcataggggtcatatttattattcataatttatttatttagcaaatatttattgagtgcttactatgttccaggccctgtttcaggtactggaaatgtagcaaataagaagcaatgtctcagttcccaaggagcttacatcctagatagaagaatcaaataatacataagtaaatgaataagtgataagtcctgtaatgatttcacattgcatacctgtatcaaaacatttcatgtaccccataaatatatacatttactatgtacccacaaaattaaaaataaaaaaatttaaaaaaggaaagaaagtcaaactcaatgatgccatagaagctgcagggatatttttaattgcacaattaagaaataccttgaagagaaggtgacacaatataatgaaataaaattagacattaatgcagtccccacaccgaatccaaaatttaagaaaaaaaagcatcttctaaatgactctgggttaaagaagaaataaaaatcatgacttcaaattatgtagatgagaatggaaataaacccaccagatgtaaaacctgggatgaggttagagttattaaagagggtcatttatacactcacttacatattcaaaaataaggaagacttaagataaatgaactagacatttaactcaagaatgtagaaaaagaacagtaaattgaatcttaaggaaatagaaggaaggaaaaataaagataagaaaaaaagaaagcaagaagaaaaaaatcacaatacaattgattgatacaagttatttgagaaaatttttttggcaattctgatcaaagaaaaaagaagagacaataaacaacattgggaattataattaaagatataaaaggcaataggaaaaatataagaaaatacaagtcagaattttataacactcaaattgaaatttcagacaaaatggatcatatattaataaaatacaactaatcaaaactggctcaagaagtagaaaacttgaatagaacaataaagagataaaaattttacttcaggccgggcatggtggctcacgcctgtaaccccagcactttgggaggccgaggtgggtggatcacttgaagtcaagagtttgaggccagcctggccaacatggtgaaacctcatctctactaaaaatacaaaaattagcccgacatggtggcacgcacctgtagtcccagctactcaggtagccgaggcatgaaaatcacgtgaacggaggttgcagtgagccaaaatcgtgccactgtactccagcctgggtgacagagcgagactctgtctcaaaaaaaaaaaaaaaaaaaaaaaaaaaaaaaaaaatcttactgcttaaaaacaaacaacaaaaggaaagaaagacaattactgtgctcagactattatttttagaaaagttcttccccaagcctttaaggaatggaaaaattctcttgttatataaactaattccagaacacagaaaacttcctaacgcatttcataaggctagtataattatattatgcatttcataaggctagtataattataataccaaaaactgaaaaaggatggtacacagaaaaagaaaactataaacggatctcatctacaaaaatgtaaaaccagatattagcaaattgaaatccagcagtttattaaaaaaaattgtcactaccgtgtgaggtttattgcaagaattcaaaggtggtccaatatttaaacatttttattgtaatctactatattaaaatcattaaaatatgataatctcaataggaaccataaaattttttgttcaaattaaacatccattcctgataacaactcctggcattctaggaatagaagtttccttaacttggcaaaggatttgtgtaggagatgcatagaaatattgtacttaatgatgaaacgtgaaaagcattcctgttatattcaggagctagactctgactataaggatgtctgttatcacctttactattcaacattactctggacttcttgttacatataataagatgaaaagataacatgaatagtataaagtatcagaaaggaaaaatattaaactgtcatttacagacaatataaatgtcttttgagaaaatcagagaaaatcaactgacaaacttttataactaataatacaaattcattagggtggcctgatacaaggtcaacattcagaaattgtagctttgctttgcaccagcaatacacaaatggaaaatggataagaagcttctatgttagaatagagggaagataccatttcaccagatctctcctaatattcaacaaaatgcagaaaaaacaaaacagcagaagaatggagatgatcatcagcaaccaaagaaaggggcacattccaatgacgtaaacttcaaaatatctcagccaagtaaagaaacaggagattccagaactgggcattgtggtgcagggtaaccaggctcttccattcctcagaagccatataagatacaggaagcacaagacaaagaatctaaacaagaaaaaagcgtaccacaaagaacagaaggaaatttccaagtactttaagctatagaacaacttaataagaatatgaacttaataaaacaagaatgcaaagatgagatgtgaaaacagcagaattaggtaaaaaggaagattgcaaactaaagaacccattaggacaaaacaacattatagaataaattataaatagagtgaaatagaaacatgtggctaaaaattgaattatggacagaggaagggcttcagataattacattgacgggaaatgaaaaagaagaaattaaatgaaataactatatgtacatatatatgtatatacatacacacacacatatatatattcttaagaaagaataaaatgtttagatctaaatagcataacatgtcctgggaagtttgattgtcatttgaaagttcgttatttcacagtgctagaatctgagatgatattttatcttattctgtgtactttattgcattgcattgcttctttataatgagcatgcatcatttttataaaaatagtgaaatcatttttctaaaaaatgtagagagaatataatgtacaaaaagccacattcacaatattaacaaaaactatgaaatattggggaatacagctaataagaaatgtataaaatctataaagaaaaccacacacacacacacacacacacacacacacacacacacacacacacacacgaaaaatgacaattttcctgaagagcacaaaagaggatgtgaataaattttaaaaatactacatgaccctgggtgaaaatactttattactaagattttaattattccttaagttgatctataaattccttttttttttttttgagacagagtcttactctgttgcccaggctggagtgcagtggcacagtctgggctcactgcaacttccacctccagggttcaagcgattttcatgcctcagcctcccgagtagcttggactacaggtgtgcgccaccacccctggctaatttttgtatttttagtaaagacgaggtttcacgatgttggtcaggctggtcttgaactcctgacctcaagtgatccacctgccgtgacctcctaaagtgctgggattacaggcatgacccaccacacccagcttaatctataaattggatgcaatcctaatgaaaagtccaacaagattttttaaaaatgaaacttggaacttcacttgaaatgcccaaggatatccaaaaatagttggaaaaagcagggcaatgaaggatttgtcttccccgacaccaaaacttgctacaaaacgacaccatgtaaaagtgtgatattgaggcagtttataactatatatattatcagtgaaacagaaaagtcaatcgatgaaacagatctgagtataaatgagaatttaacatatggttaagttagctctttaaatttattggggaataatggactattatatgaatggtgctaggatttggagacacacacacacacacacacacacacacacacacacacacacacacacacacatatatatgcaatgacccagaagccatacaagaaaaggttaatgttttgaccacatcataatgtaaaaattctggagttaggtgccatggctccagaatccaaagtgctgggattatagccctggctcatgcctgtaatcccagcactttgggaggtctgggtgggaggatcttttgagaccaggagtttgagaccagcctggggaatatagtgagaccctgtctctacaaaacataaaaattagctgggcgtggtgccatgcatttgtagtcctagctactcaggagactgaggcaggaagatcgcttaagcccaggggttcaaggcagcagtgagctatgatcacgccactgcagtccagcctgggcgacacagcgaaaccctgtctaaaaaagtaaaaattctgaatatcaaaaataccataaaattaagatgttagtgatagattgagaaaatatatgtacaacctatataacagaaaaataactaatatacagaaatgtgtaaagaactacaaaccatttaaaaaatacagctgaataggaaaatactcaaaggatattaactaatactcagagaagaaatgcaaatggatgttaagcatgtgaaattatgctcaagataatagatatttaggaaaatgtgaattaaaaggacaatcttgccaggtgcagtagctcacacctgtgtgatcccagcattttgggaggccgaggtgggtggattgcttgagctcaggagttcgaaaccaacctgggcaacatggcaaaaacccgtctataccaaaagtacaaaaattagctgggcgtggtggcatgcgcctgtagtcccagctactggggaagctgagatgggaggatcacctgagctcaggaaggtcgaggctgcagtgagctgtgattacatcactgcactccagcctgggcaacagagtgagaacctatctcaaaacaaaacaaaaaaaaggacaatcttttgttgactcttatattggcaataattactaatacagacggtccccaatttatgacaattcaacctatgatttttttactttaattggtggtgcaaaagcaatacacattcagtaaaatctgtacttcaagtactcatacaaccatcctgtttttctttcaatgtagtattcaataaattatgtgagatattcaacactttattataaaataggctttgcattagatgattttgccgaactgtcagctaatgtgagtgttccgagcatttttaaggtaggctaggctatgatgtttggtaggttggatgtattaaatgcattttagatttatggtattttcaacctataagtttatttgaacatgaccccattataagttgagaaacatttgtacacagtgtgcatgagagtgtggggaaatagatcctgtcttatgtttgatgggggtataaattgccaagcctttttggaggacagtttggtggtatatccattaactatataaaatctcacatccttcttttggcaatatcaaatgtataaaatctcatacatttaagcaaataattatatttatagtagaatatcctaaagaaattcttctacctgttggcaaagctttatgtgccagactgttcattgtaaccttgctttattagctccggatccagaactcataatatgcagcagttaaaaagaatgaagcagctttaaatgtactggtatgtagagctctttgagacataattttaaatgaaaaaaaagcaagttgcaaaacagtatgttaattatgatcctggccaggcgtggtggctcacacctgtaatcccagcactttgagaggcccaggtggttggatcacttgaggccaggagtttgagaccagcctagccaacatggtgaaacccagtctctactaaaaatacaaacattagctgggcatggtggtgcgcacctgtaatcccagctactagggaggctgaggcatgagaatcgcttgaacccgagaggtggaggttgcggtgagccaagatcgcaccactgcactccagcctgagtgaaagagcaagactccatataaaaaaaaatctcatttatatattttaataagacatgtatgtgtatatcatgtatacaaaaggttaatacaccaaacttaaaatggagaggtaactgtgatttgggtgaggataggggagtgaaagtggtactagtgctttttctgggtttgactattcttttcttttcttttcttttcagagacagggtttcacgccattgccggtctggagagcagtggtgcaatcatagttcactgtaaccttgaattcctaagctcaaacaatcttcttgccaagtagcctcccaagtagctaggaccacaggcatgcaccactaagcccagctattttttttttttaatagacaggtttccctatgtcgggaaacctatgtagggtggtctcaaactcttggcctcaagtaatgctcttgcctcagactcccaaagtattgggattataggcgtgagccatcacacttggccttgggtttgaattttatactagaattgtactcttgtgggatttgtatgtaaagtaaacagcaaatattaaaacaccccaattatctttccactgggatacacagagctaactccatcagccacattgtataaatataacatgagttatttaatctctcccctatcaatagccattttatgttgcgtcaggctttttttttttttttttttttttttgacagagtctcactctgtcagccagactggagtgcagtggcgtgatctaggctcactgcaacctccatcccttgggttcaagccattctcctgactcagccttgcaagtagctggggttataagcgcctgccactgcgcccggctaatttttgtatttttaatagaaacggggtttcaccacgttggccaggctggtcttgaactcctgacctcgtgatccacctgcttcggcctcccaaagtgctgggattacaggtgtgagccaccgtgcccggctgcgtcagttttttcaaaccttacaagcattgcgaaaaaaaaaaattctagtaaatatatctttgtgaaactgtgtaggcatataggttggctaaattccaaggaatagaattattgggtcaaagaatttgtgaaatattatagttatcatttaatagagtttgccaaattgccctatataaaaagcttgcatcaatatctgcctccaacagagtagaggagtgcccatttcttgacaaaccagtcaacaatattatcaagtttctaaactttgagaaaatcatacttgaaacatggtaaggcatagttgctttgatttgcatttctttgtttgagcatcttttcatatgtttattagtaatctatttcttttctgtgaacaaatctgttcatgtcttttggcacatttttctattgggttgtttatcattttactaatgatctgtaagagcttttagattattacaagttagccttttgacagtcaatgtttatggttttttttttttactttaccaaagtttaaaatttgtatgcaattaatttatcaatattttcctttggtggagaaagtaagttcgtcactttcaattgagttctgaaaagccattagtaagattgtaaggcactaggacttcctttcttggctcctgaaagggcctcctccacacaggggcccctcacagtggagcccctccctctggggtgtcctatttcaatgttctaagaaagaggctgcctggagggtctatatttggagtatgactcctcagcggggacaggtggatgcgtggggactaacttctgcatatttggtccctgagttttgggattattctgaggggcttgtatgggaggtgcagtgaagttgtaacacaaggcaggacatgaaaaaacttctttttcttggcaattgcttgggatcctgtacattgcccttccacttgtgagggaaaaaaataatgacacggacatcaggtgtgttgcagtgattcacagtcatccacagaccctcaccaccatctccactggaaaatattgaacactcgccactgctagggtagtatgtagtacatgaatggcagacaccggcgagatctcaagtgttacgacggatgaaaattccacctgttaagtctcctttccatccaagctctagcagttggttgttccatgggtgtggtgaggctgatctgattacatgcttatgtaaaatccaaataaagccccttgaatggaaaacaggttaatttgggaagtcactagtaaagcaggttaatttggtaagtcactagtaaagcactaggctcatcaggagttgggtcttaaatatatcctctagaagtcttctctgaagaaggtcttagacacctgaaaaaagatgctgagttcagccagaacttcaaaagttacaaatcacctgtgtaaaattgtcaatattagaaaacgaaatgtctttccaaagattaacttatagatcatattgaatacgtgctggttttgtttaggacaattttgtatttaaaatgtcaagaattactagtcaattttgaaagctgtaaaatagtttgcagtaacagaagacattttaaaatgtggcacaaaataatgtaaacaaaagaatgagtcttttgttatttttacaccctgaatattttttgtgtcaaatgaaaatggctatactgtattttctgattacaatattagaaaagaatgtcatattaaaagaaaaaaaaggaacacgaaaaagaaaattaaagctctacttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatctgatttagatttttttactggctaggactctgactgaggtgctggtgtgaggcctagaattactgcagctattttgataccattagaatgcacagtcaaggataaagctttcatgtaaggaagggtatagcagagaaaattatagaaaaatgaagcagaatcttaatcaaattgtacttaaagtcagataacttctggatgcaactcactgaagtaagaataggtggatatttcttaaatatgacaaaaatatatacatttctaacaagaagcctttcatgtttaagggataaacactagaagcatttccattaaaattaggaaaaagacaagaatgccagttatttccacaattatttaacattgttctagaagtactagttaatgcagtcaaccaagagaaagaaatgtaatattgatattggaaaggaaggggcaggcaagattatcattaccacaaatgaagcaaatctaagagaatcaactaaagactacttgaaacctttggaactccataaaaaggctggttatgaaatcaatagaataaaaactgatcactttcatatataaaaacaacaaacaaaatgtaaaataagaaaaaaaatctaaattacaatagccatgggaaaagataagctccttttgaataaacttaacaaaaaaatctgtaagacatatccattcattcagtaaatatggattgataacctacagtgtgccaggcaatgttctaggagttatttttatttaaaaaatttagaaactgctgagaaaaataaagacaaataagtagaaaaactgggttgttggatagaaagatattcctgtaaagatgccaattatcactcagttaacttataaattatgtgcaacacaaattgaaattaaaaacggtagtttttaggggactataacaaaataacagattttagtctctaaataaatacatgtgaacaggcaggtaatgataaaaaagatgagttatgagagaccttacccttcagatattgaaacatattatgaagatactatagttaaaacagtttgttatttaagaagaaagaaaagataacagattaaaagaatataataaagaataaagaaatagatacaaacatatgtggatgtttagattatgataattatggtaaagatggcactttattttttattttttgggtattatacatttaatttaaagacttcgaagtaaaaaaaaaaggtacagaaatacagattacattgtgatgaccccagtagtattctacatgacaaaaataaaaacagatttaagtaaatgtatcggcactgaacaagcatttacttaacatccaatccaggctgcatatgcacaaaatgatctgaccacatgcttatgcaaagtagtttttcttagaacgccaaaattccaaccattctgactgtccgctgcgcattcccctgttgagtattttgagcgaacttctatagaatataaaaacaattggcatggcacttaaagactgcaaaaaacagaacacaattaaaaacatttataatgcatttctgtataaaatatacaccataaagaccaccctgaataatggttaaaacctcatcatagaaaaatgctcatcattttgcacattattgatagaaactactgagaggttttcttggggggctggtgggaaggtagacacccaacttaaagattcattcaaaatttgctttaaattgtgggtaataactcactgcttacccctctcaaaatgttttatcatgaatactctaatatttaaccacaggacaaacataaagaataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccataacatatttctgacatgagatacagaattctaagtttatgatttgaagtgaatactgctttttgttttaaaacaagtttcagatgttaagagaaacatattaaataaacatgtgcatgtatataaacattttcctttgaggttttcattgctttcagacttatgttatttgaaggaaagagagtacacagctagaaactttggaaaaatgacatttccaatgaaatgtagcatccacccctccaaaaaaagataatttattaaatgcctacaaattttgaaacatttgaaatttaaactaggacactttcctaaaattaagttttactaagattaaaaaactttaagtaatttagatgatcatggttactttttaagtcccttttcattaaaaaatatttaaaataaacaacagaaggatgctatatttggcacccccttaaataaactgctaaacactaatattaataaaaaataatccaaggaactctgcctctgaaatgtattctactatgtgttacatgtgttatccagttaataaaaactcactgaaagagctga
